(12) United States Patent
Horne et al.

(10) Patent No.: US 6,974,667 B2
(45) Date of Patent: Dec. 13, 2005

(54) GENE EXPRESSION PROFILES IN LIVER CANCER

(75) Inventors: Darci T. Horne, Gaithersburg, MD (US); Uwe Scherf, Gaithersburg, MD (US); Joseph Vockley, Damascus, MD (US)

(73) Assignee: Gene Logic, Inc., Gaithersburg, MD (US)

( * ) Notice: Subject to any disclaimer, the term of this patent is extended or adjusted under 35 U.S.C. 154(b) by 503 days.

(21) Appl. No.: 09/880,107

(22) Filed: Jun. 14, 2001

(65) Prior Publication Data

US 2002/0142981 A1 Oct. 3, 2002

Related U.S. Application Data

(60) Provisional application No. 60/211,379, filed on Jun. 14, 2000, and provisional application No. 60/237,054, filed on Oct. 2, 2000.

(51) Int. Cl.[7] ........................... C12Q 1/68; C12P 19/34; C07H 21/04
(52) U.S. Cl. ........................ 435/6; 435/91.1; 536/23.1; 536/24.3
(58) Field of Search .......................... 435/6, 91.1, 91.2; 536/23.1, 24.3, 22.1; 935/6; 436/518

(56) References Cited

PUBLICATIONS

Timothy J. Yeatman et al., Identification of a differentially-expressed message associated with colon cancer liver metastasis . . . , (1995) Oxford University Press, Nucleic Acids Research, vol. 23, No. 19, pp. 4007–4008.*
Naohiro Tomita, Expression of pancreatic secretory trypsin inhibitor gene in neoplastic tissue, (Dec. 1987), vol. 225, pp. 113–119.*
Yoshitaka Ohmachi et al., Expression of the pancreatic secretory trypsin inhibitor gene in the liver infected with hepatitis B virus, Journal of Hepatology (1994), pp. 1012–1016.*
Chen CJ, Yu MW and Liaw YF. Epidemiological characteristics and risk factors of hepatocellular carcinoma. J Gastroenterol Hepatol. Oct. 1997;12(9–10):S294–308.
Di Carlo V, Ferrari G, Castoldi R, Nadalin S, Marenghi C, Molteni B, Taccagni G and Castrucci M. Surgical treatment and prognostic variables of hepatocellular carcinoma in 122 cirrhotics. Hepatogastroenterology. Jul. 1995;42(3):222–9.
Hsu DK, Dowling CA, Jeng KC, Chen JT, Yang RY and Liu FT. Galectin–3 expression is induced in cirrhotic liver and hepatocellular carcinoma. Int J Cancer. May 17, 1999;81(4):519–26.
Iurisci I, Tinari N, Natoli C, Angelucci D, Cianchetti E and Iacobelli S. Concentrations of galectin–3 in the sera of normal controls and cancer patients. Clin Cancer Res. Apr. 2000;6(4):1389–93.

Jiang WG, Bryce RP, Horrobin DF and Mansel RE. Regulation of tight junction permeability and occludin expression by polyunsaturated fatty acids. Biochem Biophys Res Commun. Mar. 17, 1998;244(2):414–20.
Johnson RC. Hepatocellular carcinoma. Hepatogastroenterology. Jan.–Feb. 1997;44(13):307–12.
Kurata T, Oguri T, Isobe T, Ishioka S and Yamakido M. Differential expression of facilitative glucose transporter (GLUT) genes in primary lung cancers and their liver metastases. Jpn J Cancer Res. Nov. 1999;90(11):1238–43.
Li D and Mrsny RJ. Oncogenic Raf–1 disrupts epithelial tight junctions via downregulation of occludin. J Cell Biol. Feb. 21, 2000;148(4):791–800.
Morita K, Furuse M, Fujimoto K and Tsukita S. Claudin multigene family encoding four–transmembrane domain protein components of tight junction strands. Proc Natl Acad Sci U S A. Jan. 19, 1999;96(2):511–6.
Nakamura M, Inufusa H, Adachi T, Aga M, Kurimoto M, Nakatani Y, Wakano T, Nakajima A, Hida JI, Miyake M, Shindo K and Yasutomi M. Involvement of galectin–3 expression in colorectal cancer progression and matastasis. Int J Oncol. Jul. 1999;15(1):143–8.
Ohmachi Y, Murata A, Matsuura N, Yasuda T, Yasuda T, Monden M, Mori T, Ogawa M and Matsubara K. Specific expression of the pancreatic–secretory–trypsin–inhibitor (PSTI) gene in hepatocellular carcinoma. Int J Cancer. Nov. 11, 1993;55(5):728–34.
Simon DB, Lu Y, Choate KA, Velazquez H, Al–Sabban E, Praga M, Casari G, Bettinelli A, Colussi G, Rodriguez–Soriano J, McCredie D, Milford D, Sanjad S and Lifton RP. Paracellin–1, a renal tight junction protein required for paracellular Mg2+ resorption. Science. Jul. 2, 1999;285(5424):103–6.
Weinberg RA. Tumor suppressor genes. Science. Nov. 22, 1991;254(5035):1138–46.
Zak J, Schneider SW, Eue I, Ludwig T and Oberleithner H. High–resistance MDCK–C7 monolayers used for measuring invasive potency of tumour cells. Pflugers Arch. May 2000;440(1):179–83.

* cited by examiner

*Primary Examiner*—Jehanne Sitton
(74) *Attorney, Agent, or Firm*—Morgan Lewis & Bockius LLP

(57) ABSTRACT

The present invention identifies the global changes in gene expression associated with liver cancer by examining gene expression in tissue from normal liver, metastatic malignant liver and hepatocellular carcinoma. The present invention also identifies expression profiles which serve as useful diagnostic markers as well as markers that can be used to monitor disease states, disease progression, drug toxicity, drug efficacy and drug metabolism.

18 Claims, 4 Drawing Sheets

GENE EXPRESSION PROFILES IN LIVER CANCER

RELATED APPLICATIONS

This application claims priority to U.S. Provisional Application No. 60/211,379, filed Jun. 14, 2000 and U.S. Provisional Application No. 60/237,054, filed Oct. 2, 2000, both of which are herein incorporated by reference in their entirety.

BACKGROUND OF THE INVENTION

Primary hepatocellular carcinoma (HCC) is a widespread cancer throughout the world, especially prevalent where the incidence of chronic hepatitis B (HBV) and hepatitis C (HCV) viral infections are endemic (Groen, (1999) Semin. Oncol. Nurs. 15, 48–57; Idilman et al., (1998) J. Viral. Hepat. 5, 110–117; Di Bisceglie et al., (1998) Hepatol. 28, 1161–1165; Johnson, (1997) Hepatogastroenerology 44, 307–312; Sheu, (1997) J. Gastroeneterol. Hepatol. 12, S309–313). Hepatocellular carcinomas are very malignant tumors that generally offer a poor prognosis, dependent on the size of the tumor, the effect on normal liver functions, and the involvement of metastases. They are best treated by surgical resection, when the tumors are diagnosed at a stage where this is a viable possibility, but the recurrence rate for these cancers remains high (Johnson, (1997) Hepatogastroenterology 44, 307–312; Schafer & Sorrell, (1999) Lancet 353, 1253–1257; Groen, (1999) Semin. Oncol. Nurs. 15, 48–57; Sitzman, (1995) World. J. Surg. 19, 790–794; DiCarlo, (1995) Hepato-Gastroenterol. 42, 222–259; Tanaka et al., (1996) Hepato-Gastroenterol. 43, 1172–1181; El-Assal et al., (1997) Surgery 122, 571–577).

Numerous risk factors for the development of HCC have been identified: cirrhosis, HBV or HCV infection, being male, alcohol-related liver disease, exposure to aflatoxins, vinyl chloride and radioactive thorium dioxide, cigarette smoking, ingestion of inorganic arsenic, the use of oral contraceptives and anabolic steroids, iron accumulation, and various inherited metabolic disorders (hemochromatosis, glycogen storage disease, porphyria, tyrosinemia, $\alpha$-1-antitrypsin deficiency) (Di Bisceglie et al., (1998) Hepatol. 28, 1161–1165; Chen et al., (1997) J. Gastroenterol. Hepatol. 12, S294–308; Schafer & Sorrell (1999) Lancet 353, 1253–1257; Groen, (1999) Semin. Oncol. Nurs. 15, 48–57; Idilman et al., (1998) J. Viral. Hepat. 5, 110–117; Johnson, (1997) Hepato-Gastroenterol. 44, 307–312).

In addition to liver tumors attributed to hepatocellular carcinoma, there are liver tumors that arise as metastases from primary tumors in other parts of the body. These tumors most often metastasize from the gastrointestinal organs, primarily the colon and rectum, but it is possible for metastatic liver cancers to occur from primary cancers throughout the body (Sitzman 1990, Groen 1999). These cancers can be treated using the routine therapies such as chemotherapy, radiotherapy, surgical resection, liver transplantation, chemoembolization, cryosurgery, or a combination of therapies (Sitzman, (1990) Hepatic Neoplasia, in Bayless (editor) Current Therapy in Gastroenterology and Liver Disease, Marcel Dekker; Groen, (1999) Semin. Oncol. Nurs. 15, 48–57).

The characterization of genes that are differentially expressed in tumorigenesis is an important step in identifying those that are intimately involved in the details of a cell's transformation from normal to cancerous. Studies examining the gene expression of metastatic liver tumors and hepatocellular carcinomas in comparison with a set of normal liver tissues would produce data identifying genes that are not expressed in normal livers but have been switched on in tumors, as well as genes that have been completely turned off in these tumors during the progression from a normal to a malignant state. Such studies would also lead to the identification of genes that are expressed in tumor tissue at differing levels, but not expressed at any level in normal liver tissue. The identification of genes and ESTs that are expressed in both types of tumors, i.e., primary hepatocellular carcinomas as well as metastatic tumors of a different origin, and not in normal liver cells would be extremely valuable for the diagnosis of liver cancer.

SUMMARY OF THE INVENTION

The present invention identifies the global changes in gene expression associated with liver cancer by examining gene expression in tissue from normal liver, metastatic malignant liver and hepatocellular carcinoma. The present invention also identifies expression profiles which serve as useful diagnostic markers as well as markers that can be used to monitor disease states, disease progression, drug toxicity, drug efficacy and drug metabolism.

The invention includes methods of diagnosing the presence or absence of liver cancer in a patient comprising the step of detecting the level of expression in a tissue sample of two or more genes from Tables 3–9; wherein differential expression of the genes in Tables 3–9 is indicative of liver cancer. In some preferred embodiments, one or more genes may be selected from a group consisting of the genes listed in Tables 3–5. In some preferred embodiments, the method may include detecting the expression level of one or more genes selected from a group consisting Tetraspan NET-6 protein; collagen, type V, alpha; and glypican 3.

The invention also includes methods of detecting the progression of liver cancer and/or differentiating nonmetastatic from metastatic disease. For instance, methods of the invention include detecting the progression of liver cancer in a patient comprising the step of detecting the level of expression in a tissue sample of two or more genes from 3–9; wherein differential expression of the genes in Tables 3–9 is indicative of liver cancer progression. In some preferred embodiments, one or more genes may be selected from a group consisting of the genes listed in Tables 3–5.

In some aspects, the present invention provides a method of monitoring the treatment of a patient with liver cancer, comprising administering a pharmaceutical composition to the patient and preparing a gene expression profile from a cell or tissue sample from the patient and comparing the patient gene expression profile to a gene expression from a cell population comprising normal liver cells or to a gene expression profile from a cell population comprising liver cancer cells or to both. In some preferred embodiments, the gene profile will include the expression level of one or more genes in Tables 3–9. In other preferred embodiments, one or more genes may be selected from a group consisting of the genes listed in Tables 3–5.

In another aspect, the present invention provides a method of treating a patient with liver cancer, comprising administering to the patient a pharmaceutical composition, wherein the composition alters the expression of at least one gene in Tables 3–9, preparing a gene expression profile from a cell or tissue sample from the patient comprising tumor cells and comparing the patient expression profile to a gene expression profile from an untreated cell population comprising liver cancer cells. In some preferred embodiments, one or more genes may be selected from a group consisting of the genes listed in Tables 3–5.

In one aspect, the present invention provides a method of diagnosing hepatocellular carcinoma in a patient, comprising detecting the level of expression in a tissue sample of two or more genes from Tables 3–9, wherein differential expression of the genes in Tables 3–9 is indicative of hepatocellular carcinoma. In some preferred embodiments, one or more genes may be selected from a group consisting of the genes listed in Tables 3 or 5

In another aspect, the present invention provides a method of detecting the progression of hepatocellular carcinoma in a patient, comprising detecting the level of expression in a tissue sample of two or more genes from Tables 3–9; wherein differential expression of the genes in Tables 3–9 is indicative of hepatocellular carcinoma progression. In some preferred embodiments, one or more genes may be selected from a group consisting of the genes listed in Tables 3 or 5.

The present invention also provides materials and methods for monitoring the treatment of a patient with a hepatocellular caricnoma. The present invention provides a method of monitoring the treatment of a patient with hepatocellular carcinoma, comprising administering a pharmaceutical composition to the patient, preparing a gene expression profile from a cell or tissue sample from the patient and comparing the patient gene expression profile to a gene expression from a cell population comprising normal liver cells or to a gene expression profile from a cell population comprising hepatocellular carcinoma cells or to both. In some preferred embodiments, the method may include detecting the level of expression of one or more genes from the genes listed in Tables 3–9. In some preferred embodiments, one or more genes may be selected from a group consisting of the genes listed in Tables 3 or 5.

In a related aspect, the present invention provides a method of treating a patient with hepatocellular carcinoma, comprising administering to the patient a pharmaceutical composition, wherein the composition alters the expression of at least one gene in Tables 3-9, preparing a gene expression profile from a cell or tissue sample from the patient comprising hepatocellular carcinoma cells and comparing the patient expression profile to a gene expression profile from an untreated cell population comprising hepatocellular carcinoma cells. In some preferred embodiments, one or more genes may be selected from a group consisting of the genes listed in Tables 3 or 5.

The present invention provides a method of diagnosing a metastatic liver tumor in a patient, comprising detecting the level of expression in a tissue sample of two or more genes from Tables 3–9, wherein differential expression of the genes in Tables 3–9 is indicative of hepatocellular carcinoma. In some preferred embodiments, one or more genes may be selected from a group consisting of the genes listed in Tables 4 or 5.

The present invention provides a method of detecting the progression of a metastatic liver tumor in a patient, comprising detecting the level of expression in a tissue sample of two or more genes from Tables 3–9, wherein differential expression of the genes in Tables 3–9 is indicative of a metastatic liver tumor progression. In some preferred embodiments, one or more genes may be selected from a group consisting of the genes listed in Tables 4 or 5.

In a related aspect, the present invention provides a method of monitoring the treatment of a patient with a metastatic liver tumor, comprising administering a pharmaceutical composition to the patient, preparing a gene expression profile from a cell or tissue sample from the patient and comparing the patient gene expression profile to a gene expression from a cell population comprising normal liver cells or to a gene expression profile from a cell population comprising metastatic liver tumor cells or to both. In some preferred embodiments, the method of the present invention may include detecting the expression level of one or more genes selected from the genes listed in Tables 3–9. In some preferred embodiments, one or more genes may be selected from a group consisting of the genes listed in Tables 4 or 5.

In some preferred embodiments, the present invention provides a method of treating a patient with a metastatic liver tumor, comprising administering to the patient a pharmaceutical composition, wherein the composition alters the expression of at least one gene in Tables 3–9, preparing a gene expression profile from a cell or tissue sample from the patient comprising metastatic liver tumor cells and comparing the patient expression profile to a gene expression profile from an untreated cell population comprising metastatic liver tumor cells. In some preferred embodiments, one or more genes may be selected from a group consisting of the genes listed in Tables 4 or 5.

The invention also includes methods of differentiating metastatic liver cancer from hepatocellular carcinoma in a patient comprising the step of detecting the level of expression in a tissue sample of two or more genes from Tables 3–9; wherein differential expression of the genes in Tables 3–9 is indicative of metastatic liver cancer rather than hepatocellular carcinoma.

The invention further includes methods of screening for an agent capable of modulating the onset or progression of liver cancer, comprising the steps of exposing a cell to the agent; and detecting the expression level of two or more genes from Tables 3–9. In some preferred embodiments, one or more genes may be selected from a group consisting of the genes listed in Tables 3–5.

Any of the methods of the invention described above may include the detection of at least 2 genes from the tables. Preferred methods may detect all or nearly all of the genes in the tables. In some preferred embodiments, one or more genes may be selected from a group consisting of the genes listed in Tables 3–5.

The invention further includes compositions comprising at least two oligonucleotides, wherein each of the oligonucleotides comprises a sequence that specifically hybridizes to a gene in Tables 3–9 as well as solid supports comprising at least two probes, wherein each of the probes comprises a sequence that specifically hybridizes to a gene in Tables 3–9. In some preferred embodiments, one or more genes may be selected from a group consisting of the genes listed in Tables 3–5.

The invention further includes computer systems comprising a database containing information identifying the expression level in liver tissue of a set of genes comprising at least two genes in Tables 3–9; and a user interface to view the information. In some preferred embodiments, one or more genes may be selected from a group consisting of the genes listed in Tables 3–5. The database may further include sequence information for the genes, information identifying the expression level for the set of genes in normal liver tissue and malignant tissue (metastatic and nonmetastatic) and may contain links to external databases such as GenBank.

The invention further comprises kits useful for the practice of one or more of the methods of the invention. In some preferred embodiments, a kit may contain one or more solid supports having attached thereto one or more oligonucleotides. The solid support may be a high-density oligonucleotide array. Kits may further comprise one or more reagents for use with the arrays, one or more signal detection and/or array-processing instruments, one or more gene expression databases and one or more analysis and database management software packages.

Lastly, the invention includes methods of using the databases, such as methods of using the disclosed computer systems to present information identifying the expression level in a tissue or cell of at least one gene in Tables 3–9, comprising the step of comparing the expression level of at least one gene in Tables 3–9 in the tissue or cell to the level of expression of the gene in the database. In some preferred embodiments, one or more genes may be selected from a group consisting of the genes listed in Tables 3–5.

BRIEF DESCRIPTION OF THE DRAWINGS

FIG. 2A is the Gene Signature Curve for normal liver tissue. FIG. 2B is the Gene Signature Curve for metastatic liver tumor samples. FIG. 2C is the Gene Signature Curve for hepatocellular carinoma samples.

DETAILED DESCRIPTION

Many biological functions are accomplished by altering the expression of various genes through transcriptional (e.g., through control of initiation, provision of RNA precursors, RNA processing, etc.) and/or translational control. For example, fundamental biological processes such as cell cycle, cell differentiation and cell death, are often characterized by the variations in the expression levels of groups of genes.

Changes in gene expression also are associated with pathogenesis. For example, the lack of sufficient expression of functional tumor suppressor genes and/or the over expression of oncogene/protooncogenes could lead to tumorgenesis or hyperplastic growth of cells (Marshall, (1991) Cell, 64,313–326; Weinberg, (1991) Science, 254, 1138–1146). Thus, changes in the expression levels of particular genes (e.g., oncogenes or tumor suppressors) serve as signposts for the presence and progression of various diseases.

Monitoring changes in gene expression may also provide certain advantages during drug screening development. Often drugs are screened and prescreened for the ability to interact with a major target without regard to other effects the drugs have on cells. Often such other effects cause toxicity in the whole animal, which prevent the development and use of the potential drug.

Figure 1:
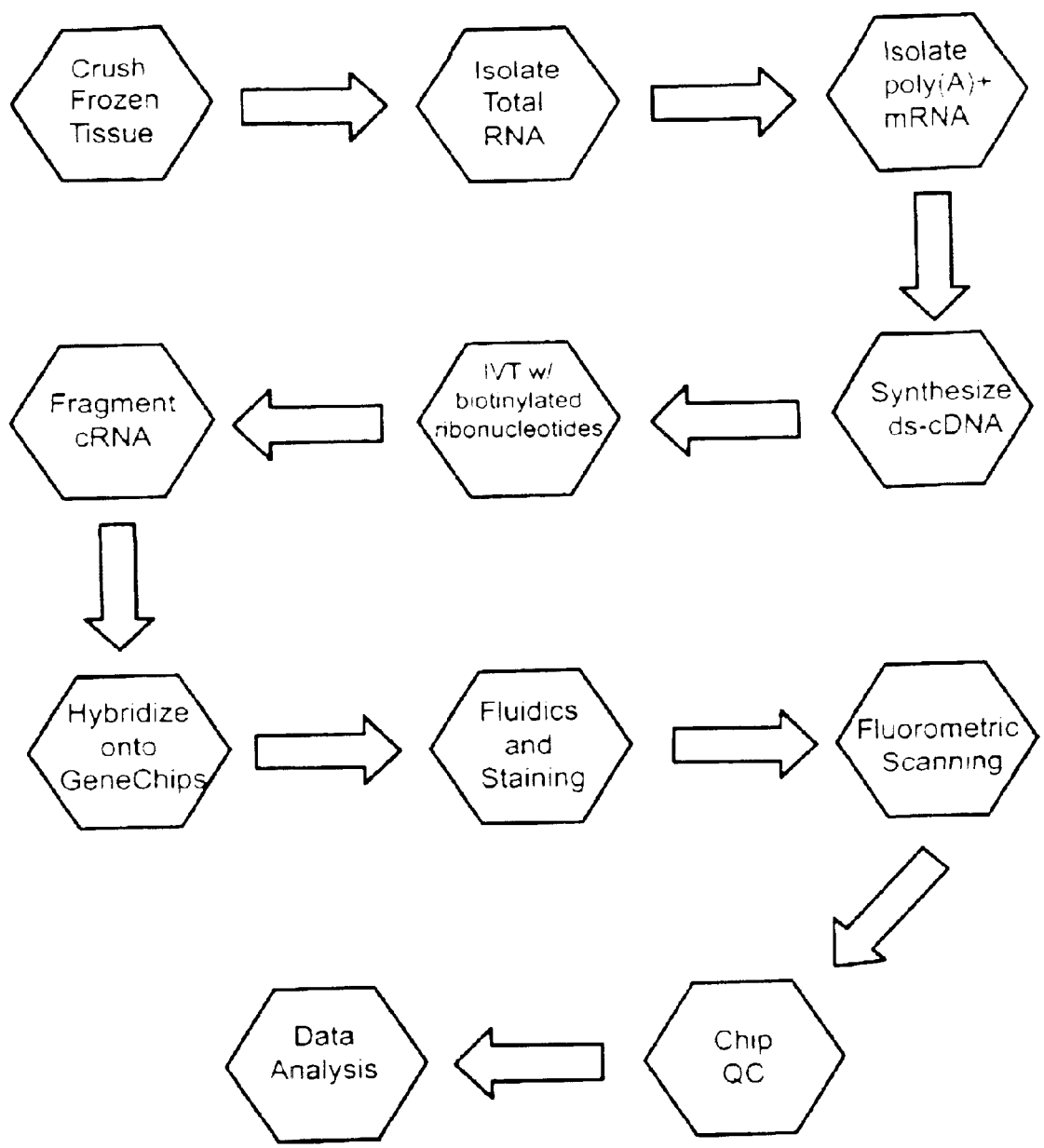
FIG. 1 is a flow chart showing a schematic representation of the experimental protocol.

The present inventors have examined tissue samples from normal liver, metastatic malignant liver and hepatocellular carcinoma to identify the global changes in gene expression associated with liver cancer. The protocol used is schematically represented in FIG. 1. These global changes in gene expression, also referred to as expression profiles, provide useful markers for diagnostic uses as well as markers that can be used to monitor disease states, disease progression, drug toxicity, drug efficacy and drug metabolism.

The present invention provides compositions and methods to detect the level of expression of genes that may be differentially expressed dependent upon the state of the cell, i.e., normal versus cancerous. As used herein, the phrase "detecting the level expression" includes methods that quantitate expression levels as well as methods that determine whether a gene of interest is expressed at all. Thus, an assay which provides a yes or no result without necessarily providing quantification of an amount of expression is an assay that requires "detecting the level of expression" as that phrase is used herein.

Assay Formats

The genes identified as being differentially expressed in liver cancer may be used in a variety of nucleic acid detection assays to detect or quantititate the expression level of a gene or multiple genes in a given sample. For example, traditional Northern blotting, nuclease protection, RT-PCR and differential display methods may be used for detecting gene expression levels. Those methods are useful for some embodiments of the invention. However, methods and assays of the invention are most efficiently designed with array or chip hybridization-based methods for detecting the expression of a large number of genes.

Any hybridization assay format may be used, including solution-based and solid support-based assay formats. Solid supports containing oligonucleotide probes for differentially expressed genes of the invention can be filters, polyvinyl chloride dishes, silicon or glass based chips, etc. Such wafers and hybridization methods are widely available, for example, those disclosed by Beattie (WO 95/11755). Any solid surface to which oligonucleotides can be bound, either directly or indirectly, either covalently or non-covalently, can be used. A preferred solid support is a high density array or DNA chip. These contain a particular oligonucleotide probe in a predetermined location on the array. Each predetermined location may contain more than one molecule of the probe, but each molecule within the predetermined location has an identical sequence. Such predetermined locations are termed features. There may be, for example, about 2, 10, 100, 1000 to 10,000; 100,000 or 400,000 of such features on a single solid support. The solid support, or the area within which the probes are attached may be on the order of a square centimeter.

Oligonucleotide probe arrays for expression monitoring can be made and used according to any techniques known in the art (see for example, Lockhart et al., (1996) Nat. Biotechnol. 14, 1675–1680; McGall et al., (1996) Proc. Nat. Acad. Sci. USA 93, 13555–13460). Such probe arrays may contain at least two or more oligonucleotides that are complementary to or hybridize to two or more of the genes described herein. Such arrays may also contain oligonucleotides that are complementary or hybridize to at least about 2, 3, 4, 5, 6, 7, 8, 9, 10, 20, 30, 50, 70, 100 or or more the genes described herein.

The genes which are assayed according to the present invention are typically in the form of mRNA or reverse transcribed mRNA. The genes may be cloned or not and the genes may be amplified or not. The cloning itself does not appear to bias the representation of genes within a population. However, it may be preferable to use polyA+RNA as a source, as it can be used with less processing steps.

The sequences of the expression marker genes are in the public databases. Tables 3-9 provide the GenBank accession number for the genes and ESTs identified called either Accession # (Tables 3, 4, and 5) or Fragment Name (Tables 6–9). The sequences of the genes in GenBank are expressly incorporated by reference as are equivalent and related sequences present in GenBank or other public databases. The column labeled "SEQ ID" refers to the sequence identification number correlating the listed gene or EST to its sequence information as provided within the sequence listing of this application.

Probes based on the sequences of the genes described herein may be prepared by any commonly available method. Oligonucleotide probes for assaying the tissue or cell sample are preferably of sufficient length to specifically hybridize only to appropriate, complementary genes or transcripts. Typically the oligonucleotide probes will be at least 10, 12, 14, 16, 18, 20 or 25 nucleotides in length. In some cases longer probes of at least 30, 40, or 50 nucleotides will be desirable.

As used herein, oligonucleotide sequences that are complementary to one or more of the genes described herein, refers to oligonucleotides that are capable of hybridizing under stringent conditions to at least part of the nucleotide sequence of said genes. Such hybridizable oligonucleotides will typically exhibit at least about 75% sequence identity at the nucleotide level to said genes, preferably about 80% or 85% sequence identity or more preferably about 90% or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The terms "background" or "background signal intensity" refer to hybridization signals resulting from non-specific binding, or other interactions, between the labeled target nucleic acids and components of the oligonucleotide array (e.g., the oligonucleotide probes, control probes, the array substrate, etc.). Background signals may also be produced by intrinsic fluorescence of the array components themselves. A single background signal can be calculated for the entire array, or a different background signal may be calculated for each target nucleic acid. In a preferred embodiment, background is calculated as the average hybridization signal intensity for the lowest 5% to 10% of the probes in the array, or, where a different background signal is calculated for each target gene, for the lowest 5% to 10% of the probes for each gene. Of course, one of skill in the art will appreciate that where the probes to a particular gene hybridize well and thus appear to be specifically binding to a target sequence, they should not be used in a background signal calculation. Alternatively, background may be calculated as the average hybridization signal intensity produced by hybridization to probes that are not complementary to any sequence found in the sample (e.g., probes directed to nucleic acids of the opposite sense or to genes not found in the sample such as bacterial genes where the sample is mammalian nucleic acids). Background can also be calculated as the average signal intensity produced by regions of the array that lack any probes at all.

The phrase "hybridizing specifically to" refers to the binding, duplexing or hybridizing of a molecule substantially to or only to a particular nucleotide sequence or sequences under stringent conditions when that sequence is present in a complex mixture (e.g., total cellular) DNA or RNA.

Assays and methods of the invention may utilize available formats to simultaneously screen at least about 100, preferably about 1000, more preferably about 10,000 and most preferably about 1,000,000 or more different nucleic acid hybridizations.

The term "mismatch control" or "mismatch probe" refer to a probe whose sequence is deliberately selected not to be perfectly complementary to a particular target sequence. For each mismatch (MM) control in a high-density array there typically exists a corresponding perfect match (PM) probe that is perfectly complementary to the same particular target sequence. The mismatch may comprise one or more bases.

While the mismatch(s) may be located anywhere in the mismatch probe, terminal mismatches are less desirable as a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions.

The term "perfect match probe" refers to a probe that has a sequence that is perfectly complementary to a particular target sequence. The test probe is typically perfectly complementary to a portion (subsequence) of the target sequence. The perfect match (PM) probe can be a "test probe", a "normalization control" probe, an expression level control probe and the like. A perfect match control or perfect match probe is, however, distinguished from a "mismatch control" or "mismatch probe."

As used herein a "probe" is defined as a nucleic acid, capable of binding to a target nucleic acid of complementary sequence through one or more types of chemical bonds, usually through complementary base pairing, usually through hydrogen bond formation. As used herein, a probe may include natural (i.e., A, G, U, C or T) or modified bases (7-deazaguanosine, inosine, etc.). In addition, the bases in probes may be joined by a linkage other than a phosphodiester bond, so long as it does not interfere with hybridization. Thus, probes may be peptide nucleic acids in which the constituent bases are joined by peptide bonds rather than phosphodiester linkages.

The term "stringent conditions" refers to conditions under which a probe will hybridize to its target subsequence, but with only insubstantial hybridization to other sequences or to other sequences such that the difference may be identified. Stringent conditions are sequence-dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH.

Typically, stringent conditions will be those in which the salt concentration is at least about 0.01 to 1.0 M sodium ion concentration (or other salts) at pH 7.0 to 8.3 and the temperature is at least about 30° C. for short probes (e.g., 10 to 50 nucleotide). Stringent conditions may also be achieved with the addition of destabilizing agents such as formamide.

The "percentage of sequence identity" or "sequence identity" is determined by comparing two optimally aligned sequences or subsequences over a comparison window or span, wherein the portion of the polynucleotide sequence in the comparison window may optionally comprise additions or deletions (i.e., gaps) as compared to the reference sequence (which does not comprise additions or deletions) for optimal alignment of the two sequences. The percentage is calculated by determining the number of positions at which the identical monomer unit (e.g., nucleic acid base or amino acid residue) occurs in both sequences to yield the number of matched positions, dividing the number of matched positions by the total number of positions in the window of comparison and multiplying the result by 100 to yield the percentage of sequence identity. Percentage sequence identity when calculated using the programs GAP or BESTFIT (see below) is calculated using default gap weights.

Homology or identity may be determined by BLAST (Basic Local Alignment Search Tool) analysis using the algorithm employed by the programs blastp, blastn, blastx, tblastn and tblastx (Karlin et al., (1990) Proc. Natl. Acad. Sci. USA 87, 2264–2268 and Altschul, (1993) J. Mol. Evol. 36, 290–300, fully incorporated by reference) which are tailored for sequence similarity searching. The approach used by the BLAST program is to first consider similar segments between a query sequence and a database sequence, then to evaluate the statistical significance of all matches that are identified and finally to summarize only those matches which satisfy a preselected threshold of significance. For a discussion of basic issues in similarity searching of sequence databases, see Altschul et al., (1994) Nature Genet. 6, 119–129) which is filly incorporated by reference. The search parameters for histogram, descriptions, alignments, expect (i.e., the statistical significance threshold for reporting matches against database sequences), cutoff, matrix and filter are at the default settings. The default scoring matrix used by blastp, blastx, tblastn, and tblastx is the BLOSUM62 matrix (Henikoff et al., (1992) Proc. Natl. Acad. Sci. USA 89, 10915–10919, fully incorporated by reference). Four blastn parameters were adjusted as follows: Q=10 (gap creation penalty); R=10 (gap extension penalty); wink=1 (generates word hits at every wink™ position along the query); and gapw=16 (sets the window width within which gapped alignments are generated). The equivalent Blastp parameter settings were Q=9; R=2; wink=1; and gapw=32. A Bestfit comparison between sequences, available in the GCG package version 10.0, uses DNA parameters GAP=50 (gap creation penalty) and LEN=3 (gap extension penalty) and the equivalent settings in protein comparisons are GAP=8 and LEN=2.

Probe Design

One of skill in the art will appreciate that an enormous number of array designs are suitable for the practice of this invention. The high density array will typically include a number of probes that specifically hybridize to the sequences of interest. See WO 99/32660 for methods of producing probes for a given gene or genes. In addition, in a preferred embodiment, the array will include one or more control probes.

High density array chips of the invention include "test probes." Test probes may be oligonucleotides that range from about 5 to about 500 or about 5 to about 50 nucleotides, more preferably from about 10 to about 40 nucleotides and most preferably from about 15 to about 40 nucleotides in length. In other particularly preferred embodiments the probes are about 20 to 25 nucleotides in length. In another preferred embodiment, test probes are double or single strand DNA sequences. DNA sequences are isolated or cloned from natural sources or amplified from natural sources using natural nucleic acid as templates. These probes have sequences complementary to particular subsequences of the genes whose expression they are designed to detect. Thus, the test probes are capable of specifically hybridizing to the target nucleic acid they are to detect.

In addition to test probes that bind the target nucleic acid(s) of interest, the high density array can contain a number of control probes. The control probes fall into three categories referred to herein as (1) normalization controls; (2) expression level controls; and (3) mismatch controls.

Normalization controls are oligonucleotide or other nucleic acid probes that are complementary to labeled reference oligonucleotides or other nucleic acid sequences that are added to the nucleic acid sample. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes thereby normalizing the measurements.

Virtually any probe may serve as a normalization control. However, it is recognized that hybridization efficiency varies with base composition and probe length. Preferred normalization probes are selected to reflect the average length of the other probes present in the array, however, they can be selected to cover a range of lengths. The normalization control(s) can also be selected to reflect the (average) base composition of the other probes in the array, however in a preferred embodiment, only one or a few probes are used and they are selected such that they hybridize well (i.e., no secondary structure) and do not match any target-specific probes.

Expression level controls are probes that hybridize specifically with constitutively expressed genes in the biological sample. Virtually any constitutively expressed gene provides a suitable target for expression level controls. Typical expression level control probes have sequences complementary to subsequences of constitutively expressed "housekeeping genes" including, but not limited to the β-actin gene, the transferrin receptor gene, the GAPDH gene, and the like.

Mismatch controls may also be provided for the probes to the target genes, for expression level controls or for normalization controls. Mismatch controls are oligonucleotide probes or other nucleic acid probes identical to their corresponding test or control probes except for the presence of one or more mismatched bases. A mismatched base is a base selected so that it is not complementary to the corresponding base in the target sequence to which the probe would otherwise specifically hybridize. One or more mismatches are selected such that under appropriate hybridization conditions (e.g., stringent conditions) the test or control probe would be expected to hybridize with its target sequence, but the mismatch probe would not hybridize (or would hybridize to a significantly lesser extent). Preferred mismatch probes contain a central mismatch. Thus, for example, where a probe is a twenty-mer, a corresponding mismatch probe will have the identical sequence except for a single base mismatch (e.g., substituting a G, a C or a T for an A) at any of positions 6 through 14 (the central mismatch).

Mismatch probes thus provide a control for non-specific binding or cross hybridization to a nucleic acid in the sample other than the target to which the probe is directed. Mismatch probes also indicate whether a hybridization is specific or not. For example, if the target is present the perfect match probes should be consistently brighter than the mismatch probes. In addition, if all central mismatches are present, the mismatch probes can be used to detect a mutation. The difference in intensity between the perfect match and the mismatch probe (I(BM)-I(MM)) provides a good measure of the concentration of the hybridized material.

Nucleic Acid Samples

As is apparent to one of ordinary skill in the art, nucleic acid samples used in the methods and assays of the invention may be prepared by any available method or process. Methods of isolating total mRNA are also well known to those of skill in the art. For example, methods of isolation and purification of nucleic acids are described in detail in Chapter 3 of Laboratory Techniques in Biochemistry and Molecular Biology: Hybridization With Nucleic Acid Probes, Part I Theory and Nucleic Acid Preparation, Tijssen, (1993) (editor) Elsevier Press. Such samples include RNA samples, but also include cDNA synthesized from a mRNA sample isolated from a cell or tissue of interest. Such samples also include DNA amplified from the cDNA, and an RNA transcribed from the amplified DNA. One of skill in the art would appreciate that it is desirable to inhibit or destroy RNase present in homogenates before homogenates can be used.

Biological samples may be of any biological tissue or fluid or cells from any organism as well as cells raised in vitro, such as cell lines and tissue culture cells. Frequently the sample will be a "clinical sample" which is a sample derived from a patient. Typical clinical samples include, but are not limited to, sputum, blood, blood-cells (e.g., white cells), tissue or fine needle biopsy samples, urine, peritoneal fluid, and pleural fluid, or cells therefrom.

Biological samples may also include sections of tissues, such as frozen sections or formalin fixed sections taken for histological purposes.

Forming High Density Arrays

Methods of forming high density arrays of oligonucleotides with a minimal number of synthetic steps are known. The oligonucleotide analogue array can be synthesized on a solid substrate by a variety of methods, including, but not limited to, light-directed chemical coupling, and mechanically directed coupling (see Pirrung et al., (1992) U.S. Pat. No. 5,143,854; Fodor et al., (1998) U.S. Pat. No. 5,800,992; Chee et al, (1998) U.S. Pat. No. 5,837,832

In brief, the light-directed combinatorial synthesis of oligonucleotide arrays on a glass surface proceeds using automated phosphoramidite chemistry and chip masking techniques. In one specific implementation, a glass surface is derivatized with a silane reagent containing a functional group, e.g., a hydroxyl or amine group blocked by a photolabile protecting group. Photolysis through a photolithogaphic mask is used selectively to expose functional groups which are then ready to react with incoming 5' photoprotected nucleoside phosphoramidites. The phosphoramidites react only with those sites which are illuminated (and thus exposed by removal of the photolabile blocking group). Thus, the phosphoramidites only add to those areas selectively exposed from the preceding step. These steps are repeated until the desired array of sequences have been synthesized on the solid surface. Combinatorial synthesis of different oligonucleotide analogues at different locations on the array is determined by the pattern of illumination during synthesis and the order of addition of coupling reagents.

In addition to the foregoing, additional methods which can be used to generate an array of oligonucleotides on a single substrate are described in Fodor et al., (1993). WO 93/09668. High density nucleic acid arrays can also be fabricated by depositing premade or natural nucleic acids in predetermined positions. Synthesized or natural nucleic acids are deposited on specific locations of a substrate by light directed targeting and oligonucleotide directed targeting. Another embodiment uses a dispenser that moves from region to region to deposit nucleic acids in specific spots.

Hybridization

Nucleic acid hybridization simply involves contacting a probe and target nucleic acid under conditions where the probe and its complementary target can form stable hybrid duplexes through complementary base pairing (see Lockhart et al., (1999) WO 99/32660). The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids.

Under low stringency conditions (e.g., low temperature and/or high salt) hybrid duplexes (e.g., DNA-DNA, RNA-RNA or RNA-DNA) will form even where the annealed sequences are not perfectly complementary.

Thus specificity of hybridization is reduced at lower stringency. Conversely, at higher stringency (e.g., higher temperature or lower salt) successful hybridization requires fewer mismatches. One of skill in the art will appreciate that hybridization conditions may be selected to provide any degree of stringency. In a preferred embodiment, hybridization is performed at low stringency, in this case in 6×SSPE-T at 37° C. (0.005% Triton x-100) to ensure hybridization and then subsequent washes are performed at higher stringency (e.g., 1×SSPE-T at 37° C.) to eliminate mismatched hybrid duplexes. Successive washes may be performed at increasingly higher stringency (e.g., down to as low as 0.25×SSPET at 37° C. to 50° C.) until a desired level of hybridization specificity is obtained. Stringency can also be increased by addition of agents such as formamide. Hybridization specificity may be evaluated by comparison of hybridization to the test probes with hybridization to the various controls that can be present (e.g., expression level control, normalization control, mismatch controls, etc.).

In general, there is a tradeoff between hybridization specificity (stringency) and signal intensity. Thus, in a preferred embodiment, the wash is performed at the highest stringency that produces consistent results and that provides a signal intensity greater than approximately 10% of the background intensity. Thus, in a preferred embodiment, the hybridized array may be washed at successively higher stringency solutions and read between each wash. Analysis of the data sets thus produced will reveal a wash stringency above which the hybridization pattern is not appreciably altered and which provides adequate signal for the particular oligonucleotide probes of interest.

Signal Detection

The hybridized nucleic acids are typically detected by detecting one or more labels attached to the sample nucleic acids. The labels may be incorporated by any of a number of means well known to those of skill in the art (see Lockhart et al., (1999) WO 99/32660).

Databases

The present invention includes relational databases containing sequence information, for instance for the genes of Tables 3–9, as well as gene expression information in various liver tissue samples. Databases may also contain information associated with a given sequence or tissue sample such as descriptive information about the gene associated with the sequence information, or descriptive information concerning the clinical status of the tissue sample, or the patient from which the sample was derived. The database may be designed to include different parts, for instance a sequences database and a gene expression database. Methods for the configuration and construction of such databases are widely available, for instance, see Akerblom et al., (1999) U.S. Pat. No. 5,953,727, which is herein incorporated by reference in its entirety.

The databases of the invention may be linked to an outside or external database. In a preferred embodiment, as described in Tables 3–9, the external database is GenBank and the associated databases maintained by the National Center for Biotechnology Information (NCBI).

Any appropriate computer platform may be used to perform the necessary comparisons between sequence information, gene expression information and any other information in the database or provided as an input. For example, a large number of computer workstations are available from a variety of manufacturers, such has those available from Silicon Graphics. Client-server environments, database servers and networks are also widely available and appropriate platforms for the databases of the invention.

The databases of the invention may be used to produce, among other things, electronic Northerns to allow the user to determine the cell type or tissue in which a given gene is expressed and to allow determination of the abundance or expression level of a given gene in a particular tissue or cell.

The databases of the invention may also be used to present information identifying the expression level in a tissue or cell of a set of genes comprising at least one gene in Tables 3–9 comprising the step of comparing the expression level of at least one gene in Tables 3–9 in the tissue to the level of expression of the gene in the database. Such methods may be used to predict the physiological state of a given tissue by comparing the level of expression of a gene or genes in Tables 3–9 from a sample to the expression levels found in tissue from normal liver, malignant liver or hepatocellular carcinoma. Such methods may also be used in the drug or agent screening assays as described below.

Kits

The invention further includes kits combining, in different combinations, high-density oligonucleotide arrays, reagents for use with the arrays, signal detection and array-processing instruments, gene expression databases and analysis and database management software described above. The kits may be used, for example, to predict or model the toxic response of a test compound, to monitor the progression of liver disease states, to identify genes that show promise as new drug targets and to screen known and newly designed drugs as discussed above.

The databases packaged with the kits are a compilation of expression patterns from human or laboratory animal genes and gene fragments (corresponding to the genes of Table 3–9). Data is collected from a repository of both normal and diseased animal tissues and provides reproducible, quantitative results, i.e., the degree to which a gene is up-regulated or down-regulated under a given condition.

The kits may used in the pharmaceutical industry, where the need for early drug testing is strong due to the high costs associated with drug development, but where bioinformatics, in particular gene expression informatics, is still lacking. These kits will reduce the costs, time and risks associated with traditional new drug screening using cell cultures and laboratory animals. The results of large-scale drug screening of pre-grouped patient populations, pharmacogenomics testing, can also be applied to select drugs with greater efficacy and fewer side-effects. The kits may also be used by smaller biotechnology companies and research institutes who do not have the facilities for performing such large-scale testing themselves.

Databases and software designed for use with use with microarrays is discussed in Balaban et al., U.S. Pat. No. Nos. 6,229,911, a computer-implemented method for managing information, stored as indexed tables, collected from small or large numbers of microarrays, and U.S. Pat. No. 6,185,561, a computer-based method with data mining capability for collecting gene expression level data, adding additional attributes and reformatting the data to produce answers to various queries. Chee et al., U.S. Pat. No. 5,974,164, disclose a software-based method for identifying mutations in a nucleic acid sequence based on differences in probe fluorescence intensities between wild type and mutant sequences that hybridize to reference sequences.

Diagnostic Uses for the Liver Cancer Markers

As described above, the genes and gene expression information provided in Tables 3–9 may be used as diagnostic markers for the prediction or identification of the malignant state of the liver tissue. For instance, a liver tissue sample or other sample from a patient may be assayed by any of the methods described above, and the expression levels from a gene or genes from the Tables, in particular the genes in Tables 3–5, may be compared to the expression levels found in normal liver tissue, tissue from metastatic liver cancer or hepatocellular carcinoma tissue. Expression profiles generated from the tissue or other sample that substantially resemble an expression profile from normal or diseased liver tissue may be used, for instance, to aid in disease diagnosis. Comparison of the expression data, as well as available sequence or other information may be done by researcher or diagnostician or may be done with the aid of a computer and databases as described above.

Use of the Liver Cancer Markers for Monitoring Disease Progression

As described above, the genes and gene expression information provided in Tables 3–9 may also be used as markers for the monitoring of disease progression, for instance, the development of liver cancer. For instance, a liver tissue sample or other sample from a patient may be assayed by any of the methods described above, and the expression levels in the sample from a gene or genes from or 3–9 may be compared to the expression levels found in normal liver tissue, tissue from metastatic liver cancer or hepatocellular carcinoma tissue. Comparison of the expression data, as well as available sequence or other information may be done by researcher or diagnostician or may be done with the aid of a computer and databases as described above.

Use of the Liver Cancer Markers for Drug Screening

According to the present invention, the genes identified in Tables 3–9 may be used as markers to evaluate the effects of a candidate drug or agent on a cell, particularly a cell undergoing malignant transformation, for instance, a liver cancer cell or tissue sample. A candidate drug or agent can be screened for the ability to simulate the transcription or expression of a given marker or markers (drug targets) or to down-regulate or counteract the transcription or expression of a marker or markers. According to the present invention, one can also compare the specificity of drugs' effects by looking at the number of markers which the drugs have and comparing them. More specific drugs will have fewer transcriptional targets. Similar sets of markers identified for two drugs indicates a similarity of effects.

Assays to monitor the expression of a marker or markers as defined in Tables 3–9 may utilize any available means of monitoring for changes in the expression level of the nucleic acids of the invention. As used herein, an agent is said to modulate the expression of a nucleic acid of the invention if it is capable of up- or down-regulating expression of the nucleic acid in a cell.

In one assay format, gene chips containing probes to at least two genes from Tables 3–9 may be used to directly monitor or detect changes in gene expression in the treated or exposed cell as described in more detail above. In another format, cell lines that contain reporter gene fusions between the open reading frame and/or the 3' or 5' regulatory regions of a gene in Tables 3–9 and any assayable fusion partner may be prepared. Numerous assayable fusion partners are known and readily available including the firefly luciferase gene and the gene encoding chloramphenicol acetyltransferase (Alam et al., (1990) Anal. Biochem. 188, 245–254). Cell lines containing the reporter gene fusions are then exposed to the agent to be tested under appropriate conditions and time. Differential expression of the reporter gene between samples exposed to the agent and control samples identifies agents which modulate the expression of the nucleic acid.

Additional assay formats may be used to monitor the ability of the agent to modulate the expression of a gene identified in Tables 3–9. For instance, as described above, mRNA expression may be monitored directly by hybridization of probes to the nucleic acids of the invention. Cell lines are exposed to the agent to be tested under appropriate conditions and time and total RNA or mRNA is isolated by standard procedures such those disclosed in Sambrook et al., (1989) Molecular Cloning—A Laboratory Manual, Cold Spring Harbor Laboratory Press).

In another assay format, cells or cell lines are first identified which express the gene products of the invention physiologically. Cell and/or cell lines so identified would be expected to comprise the necessary cellular machinery such that the fidelity of modulation of the transcriptional apparatus is maintained with regard to exogenous contact of agent with appropriate surface transduction mechanisms and/or the cytosolic cascades. Such cell lines may be, but are not required to be, derived from liver tissue. Further, such cells or cell lines may be transduced or transfected with an expression vehicle (e.g., a plasmid or viral vector) construct comprising an operable non-translated 5'-promoter containing end of the structural gene encoding the instant gene products fused to one or more antigenic fragments, which are peculiar to the instant gene products, wherein said fragments are under the transcriptional control of said promoter and are expressed as polypeptides whose molecular weight can be distinguished from the naturally occurring polypeptides or may further comprise an immunologically distinct tag. Such a process is well known in the art (see Sambrook et al., (1989) Molecular Cloning—A Laboratory Manual, Cold Spring Harbor Laboratory Press).

Cells or cell lines transduced or transfected as outlined above are then contacted with agents under appropriate conditions; for example, the agent comprises a pharmaceutically acceptable excipient and is contacted with cells comprised in an aqueous physiological buffer such as phosphate buffered saline (PBS) at physiological pH, Eagles balanced salt solution (BSS) at physiological pH, PBS or BSS comprising serum or conditioned media comprising PBS or BSS and serum incubated at 37° C. Said conditions may be modulated as deemed necessary by one of skill in the art. Subsequent to contacting the cells with the agent, said cells will be disrupted and the polypeptides of the lysate are fractionated such that a polypeptide fraction is pooled and contacted with an antibody to be further processed by immunological assay (e.g., ELISA, immunoprecipitation or Western blot). The pool of proteins isolated from the "agent-contacted" sample will be compared with a control sample where only the excipient is contacted with the cells and an increase or decrease in the immunologically generated signal from the "agent-contacted" sample compared to the control will be used to distinguish the effectiveness of the agent.

Another embodiment of the present invention provides methods for identifying agents that modulate the levels, concentration or at least one activity of a protein(s) encoded by the genes in Tables 3–9. Such methods or assays may utilize any means of monitoring or detecting the desired activity.

In one format, the relative amounts of a protein of the invention between a cell population that has been exposed to the agent to be tested compared to an unexposed control cell population may be assayed. In this format, probes such as specific antibodies are used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, such as a specific antibody.

Agents that are assayed in the above methods can be randomly selected or rationally selected or designed. As used herein, an agent is said to be randomly selected when the agent is chosen randomly without considering the specific sequences involved in the association of the a protein of the invention alone or with its associated substrates, binding partners, etc. An example of randomly selected agents is the use a chemical library or a peptide combinatorial library, or a growth broth of an organism.

As used herein, an agent is said to be rationally selected or designed when the agent is chosen on a nonrandom basis which takes into account the sequence of the target site and/or its conformation in connection with the agents action. Agents can be rationally selected or rationally designed by utilizing the peptide sequences that make up these sites.

For example, a rationally selected peptide agent can be a peptide whose amino acid sequence is identical to or a derivative of any functional consensus site.

The agents of the present invention can be, as examples, peptides, small molecules, vitamin derivatives, as well as carbohydrates. Dominant negative proteins, DNA encoding these proteins, antibodies to these proteins, peptide fragments of these proteins or mimics of these proteins may be introduced into cells to affect function. "Mimic" as used herein refers to the modification of a region or several regions of a peptide molecule to provide a structure chemically different from the parent peptide but topographically and functionally similar to the parent peptide (see Grant, (1995) in Molecular Biology and Biotechnology Meyers (editor) VCH Publishers). A skilled artisan can readily recognize that there is no limit as to the structural nature of the agents of the present invention.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

EXAMPLES

Example 1

Tissue Sample Acquisition and Preparation

FIG. 1 outlines the experimental protocol used. Liver tissue samples were excised and snap frozen in liquid nitrogen. The clinical data for each of the samples included in this study are outlined in Table 1. The sample set was composed of eight samples of normal liver tissue (N1–N8), five samples of metastatic adenocarcinoma arising from rectum (designated M1 and M3) and colon (M2, M4 and M5) tissues and six samples of primary hepatocellular carcinomas. Samples were named according to type of tissue: HCC=hepatocellular carcinoma, M=metastatic, N=normal. Table 1 include the TNM classification (the American Joint Committee on Cancer's system of classifying cancers) of the tissues used as samples where T refers to the extent of the primary tumor, N refers to the absence or presence and extent of regional lymph node metastasis, and M refers to the absence or presence of distant metastasis. Numbers following T, N, and M refer to the size of the primary tumor and the amount of vascular invasion, where 0=no evidence of tumor, lymph node involvement or metastasis, 4=multiple tumors involved, and x=cannot be assessed. Histopathologic grade (Table 1) is a qualitative assessment of differentiation of a tumor, where G1=most differentiated and G4=undifferentiated. Clinical stage (Table 1) characterizes the anatomic extent of disease in the patient from whom the sample was taken, where I and II are early stages, III and IV are late stages.

With minor modifications, the sample preparation protocol followed the Affymetrix GeneChip Expression Analysis Manual. Frozen tissue was first ground to powder using the Spex Certiprep 6800 Freezer Mill. Total RNA was then extracted using Trizol (Life Technologies). The total RNA yield for each sample (average tissue weight of 300 mg) was 200–500 $\mu$g. Next, mRNA was isolated using the Oligotex mRNA Midi kit (Qiagen). Since the mRNA was eluted in a final volume of 400 $\mu$l, an ethanol precipitation step was required to bring the concentration to 1 $\mu$g/$\mu$l. Using 1–5 $\mu$g of mRNA, double stranded cDNA was created using the SuperScript Choice system (Gibco-BRL). First strand cDNA synthesis was primed with a T7-(dT$_{24}$) oligonucleotide. The cDNA was then phenol-chloroform extracted and ethanol precipitated to a final concentration of 1 $\mu$g/$\mu$l.

From 2 $\mu$g of cDNA, cRNA was synthesized according to standard procedures. To biotin label the cRNA, nucleotides Bio-11 -CTP and Bio-16-UTP (Enzo Diagnostics) were added to the reaction. After a 37° C. incubation for six hours, the labeled cRNA was cleaned up according to the Rneasy Mini kit protocol (Qiagen). The cRNA was then fragmented (5×fragmentation buffer: 200 mM Tris-Acetate (pH 8.1), 500 mM KOAc, 150 mM MgOAc) for thirty-five minutes at 94° C. 55 $\mu$g of fragmented cRNA was hybridized on the human Hu35 k set and the HuGeneFL array for twenty-four hours at 60 rpm in a 45° C. hybridization oven The chips were washed and stained with Streptavidin Phycoerythrin (SAPE) (Molecular Probes) in Affymetrix fluidics stations. To amplify staining, SAPE solution was added twice with an anti-streptavidin biotinylated antibody (Vector Laboratories) staining step in between. Hybridization to the probe arrays was detected by fluorometric scanning (Hewlett Packard Gene Array Scanner). Following hybridization and scanning, the microarray images were analyzed for quality control, looking for major chip defects or abnormalities in hybridization signal. After all chips passed QC, the data was analyzed using Affymetrix GeneChip software (v3.0), and Experimental Data Mining Tool (EDMT) software (v1.0).

Example 2

Gene Expression Analysis

All samples were prepared as described and hybridized onto the Affymetrix HuGeneFL array and the Human Hu35k set of arrays. Each chip contains 16–20 oligonucleotide probe pairs per gene or cDNA clone. These probe pairs include perfectly matched sets and mismatched sets, both of which are necessary for the calculation of the average difference. The average difference is a measure of the intensity difference for each probe pair, calculated by subtracting the intensity of the mismatch from the intensity of the perfect match. This takes into consideration variability in hybridization among probe pairs and other hybridization artifacts that could affect the fluorescence intensities. Using the average difference value that has been calculated, the GeneChip software then makes an absolute call for each gene or EST.

The absolute call of present, absent or marginal is used to generate a Gene Signature, a tool used to identify those genes that are commonly present or commonly absent in a given sample set, according to the absolute call. For each set of samples, a median average difference was figured using the average differences of each individual sample within the set. The median average difference must be greater than 150 to assure that the expression level is well above the background noise of the hybridization. For the purposes of this study, only the genes and ESTs with a median average difference greater than 150 have been further studied in detail.

The Gene Signature for one set of samples is compared to the Gene Signature of another set of samples to determine the Gene Signature Differential. This comparison identifies the genes that are consistently present in one set of samples and consistently absent in the second set of samples.

The Gene Signature Curve is a graphic view of the number of genes consistently present in a given set of samples as the sample size increases, taking into account the genes commonly expressed among a particular set of samples, and discounting those genes whose expression is variable among those samples. The curve is also indicative of the number of samples necessary to generate an accurate Gene Signature. As the sample number increases, the number of genes common to the sample set decreases. The curve is generated using the positive Gene Signatures of the samples in question, determined by adding one sample at a time to the Gene Signature, beginning with the sample with the smallest number of present genes and adding samples in ascending order. The curve displays the sample size required for the most consistency and the least amount of expression variability from sample to sample. The point where this curve begins to level off represents the minimum number of samples required for the Gene Signature. Graphed on the x-axis is the number of samples in the set, and on the y-axis is the number of genes in the positive Gene Signature.

Example 3

Gene Expression Analysis of Normal Liver Tissue

Figure 2A:
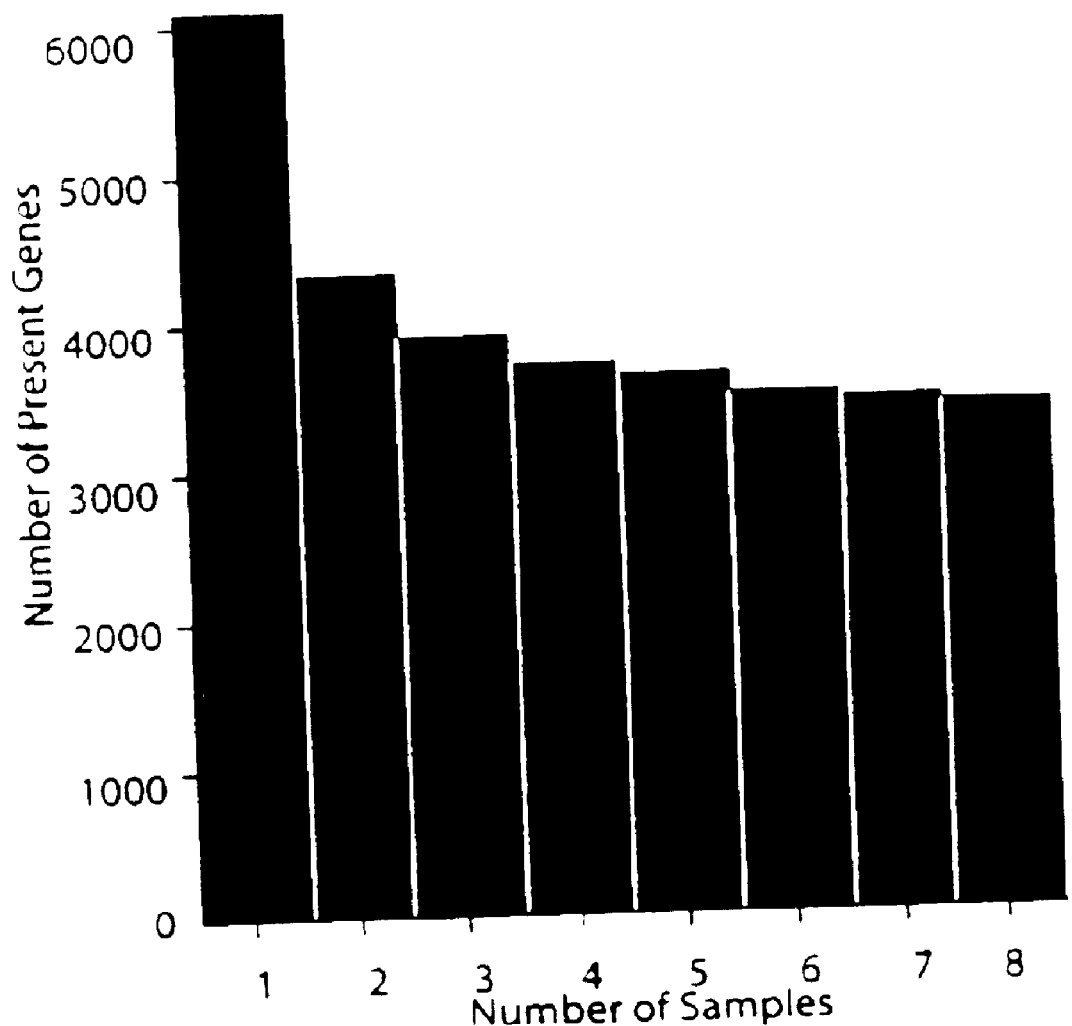
FIGS. 2A–2C are graphs of the number of genes present in all samples as a function of the number of samples for the second sample set.
Figure 2B:
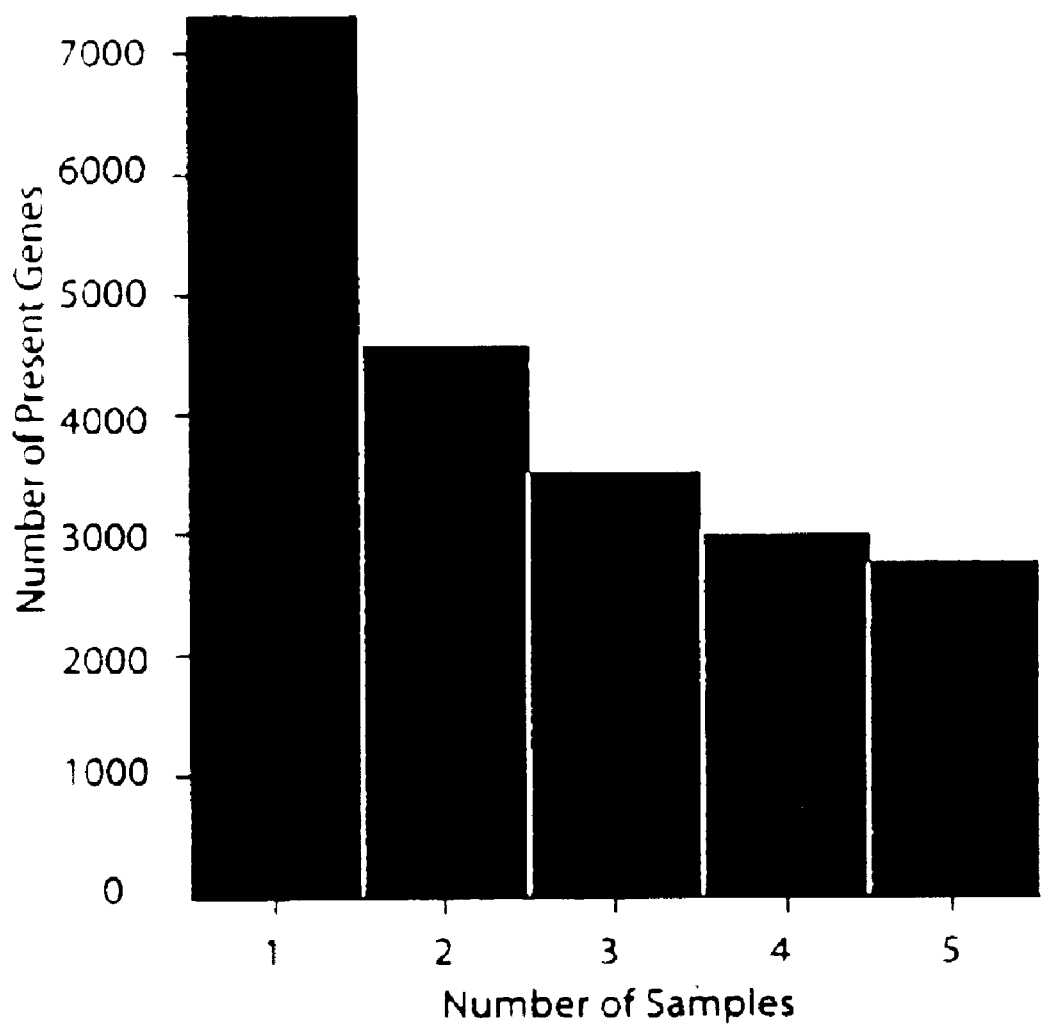
Figure 2C:
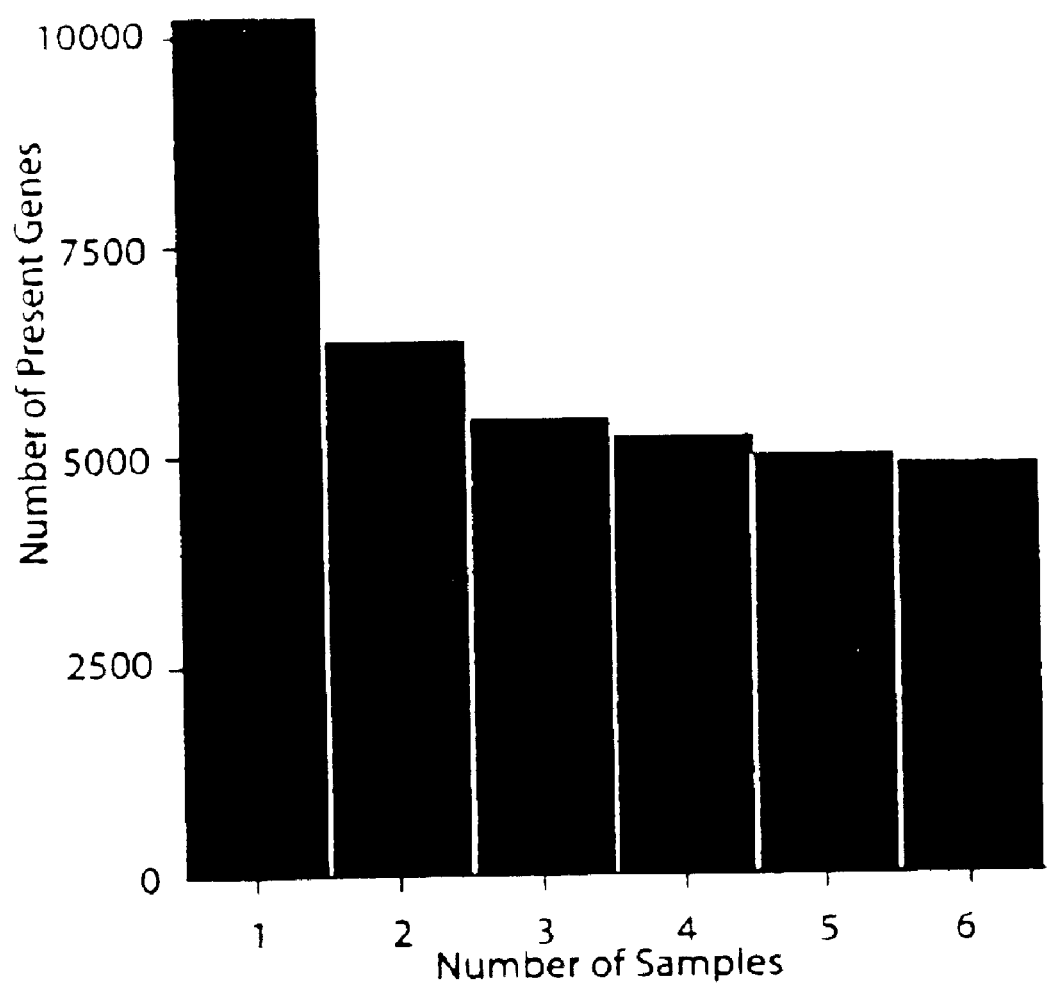

The gene expression patterns and Gene Signature were individually determined for each sample set: eight samples with normal liver pathology, six samples whose pathology indicated the primary malignancy to be hepatocellular carcinoma, and five samples whose primary colorectal adenocarcinoma had metastasized to the liver. The Gene Signatures obtained for the sample set are shown in FIG. 2

The Gene Signature considers the present and absent genes alone, and does not take into consideration those that have been called marginal. Table 2 shows the numbers of present genes, called the positive Gene Signature, and the number of absent genes, called the negative Gene Signature, for each of the three sets of samples.

The Gene Signature is the set of genes that are commonly present or commonly absent in N-1 samples of a given sample set. The positive Gene Signature for the normal liver tissues contains 6,213 genes and ESTs. This same set of normal samples did not show any detectable level of expression of 24,900 genes. Many of the genes and ESTs in this positive Gene Signature are housekeeping genes or structural genes that are not only expressed in the liver, but are ubiquitously expressed in tissues throughout the body. Within this positive Gene Signature are also those genes whose expression is specifically restricted to normal liver tissue and those genes required for the liver to function at its normal capacities. It is the group of genes unique to the liver whose expression levels are most likely to change during tumorigenesis. Whether up-regulated or down-regulated or turned completely on or turned completely off, the changes in expression of these vital genes very likely contributes to the drastic changes in liver function caused by the transformation of normal liver cells into cancerous cells.

Example 4

Gene Expression Analysis of Malignant Liver Tissue

There are 8,479 genes and ESTs in the positive Gene Signature for the HCC tumors, and a total of 23,233 genes and ESTs are included in the negative Gene Signature of the HCC samples. This negative Gene Signature includes all the genes that have been completely turned off during tumorigenesis, as well as those genes that are not usually expressed in liver tissue. These results include a number of genes and ESTs that are not regularly expressed in liver tissues, but through the process of tumor production, their expression patterns have been dramatically altered from no detectable level of expression to some significant level of expression in comparison with the normal liver.

The colorectal metastases in the liver commonly express 5,102 genes and ESTs, and do not show expression of 30,455 additional genes and ESTs. As with the negative Gene Signature for the HCC sample set, the genes included in this data set are generally not expressed in liver tissue, whether tumor or normal tissue. The 5,102 in the sample set of metastatic tumors also identify those genes with expression levels that have been changed from off to on as a result of tumor formation.

Example 5

Analysis of Gene Expression Profiles

A differential comparison of the genes and ESTs expressed in the normals and the two different types of liver tumors identifies a subset of the genes included in the positive Gene Signatures that are uniquely expressed in each sample set. This Gene Signature Differential highlights genes whose expression profiles have most dramatically changed in the transformation from normal to diseased liver cells. The parameters for these analyses were set to accommodate variation in expression of one eight normal samples and one of the six HCC samples or one of the 5 metastatic tumor samples, such that the genes categorized as unique to normal were called present by the software in seven of eight (87%) normal liver samples and were also called absent in five of six HCC (83%) or four of five (80%) metastatic liver tumor. Conversely, the genes categorized as unique to each set of tumors as compared to the normal livers were called present in five of six HCC (83%) or four of five (80%) metastatic tumor samples and absent in seven of eight normal livers (87%).

The Gene Signature Differential comparing the normal livers to those with metastatic tumors identified a total of 903 sequences expressed only in normal liver tissue. The number of genes or ESTs that meet the median average difference minimum of 150 is 449, of which 289 are genes and the number of ESTs is 160. The remaining ESTs and genes may be indistinguishable from the background noise of the hybridization. The same comparison of normals versus metastatic tumors demonstrates that in the metastatic tumor samples there are 296 uniquely expressed sequences. Those that meet the median average difference minimum requirement are 83 genes and 72 ESTs. Those genes and ESTs expressed in metastatic and not in normal liver tissue are shown in Table 9A and those present in normal liver tissue and not metastatic tissue Table 9B. Numerous genes with differing expression levels in metastatic liver tumor tissue compared to normal tissue were identified. The fifteen genes whose expression level was most different in metastatic as compared to normal tissue are shown in Table 4. Those with the most increased expression are in Table 4A and those with the most decreased expression are in Table 4B. Expression levels were determined by comparing the mean expression values of individual genes in tumor and normal liver samples. Fold change was calculated as a ratio with a p value given as a measure of statistical significance. Fold change is considered significant for a given gene or EST when it is greater than 3.0 with a p value <0.05. Only the characterized genes have been listed; the ESTs with similar fold changes are not presented here. Asterisk (*) in Table 4 denotes those genes that were also identified in the Gene Signature differential between metastatic liver carcinoma and normal liver tissue. A complete listing of all the genes and ESTs with at least a three-fold change in expression is shown in Table 6. Table 6A contains those genes and ESTs whose expression level increased in metastatic tissue relative to normal tissue and Table 6B contains those genes and ESTs whose expression level decreased.

The Gene Signature Differential between the normal liver samples and the HCC samples identifies a total of 47 unique expressers in the normals, 23 with an median average difference of 150, 13 of which are named gene and 10 of which are ESTs. When comparing the expression of the HCC samples with the normal livers, there are 243 genes and ESTs only expressed in the HCC samples.

Those genes and ESTs expressed in HCC and not in normal liver tissue are shown in Table 8A and those present in normal liver tissue and not HCC are shown in Table 8B. Numerous genes with differing expression levels in HCC compared to normal tissue were identified. The fifteen genes whose expression level was most different in HCC as compared to normal tissue are shown in Table 3. Those with the most increased expression are in Table 3A and those with the most decreased expression are in Table 3B. Expression levels were determined by comparing the mean expression values of individual genes in tumor and normal liver samples. Fold change was calculated as a ratio with a p value given as a measure of statistical significance. Fold change is considered significant for a given gene or EST when it is greater than 3.0 with a p value <0.05. Only the characterized genes have been listed; the ESTs with similar fold changes are not presented here. Asterisk (*) in Table 3 denotes those genes that were also identified in the Gene Signature differential between hepatocellular carcinoma and normal liver tissue. A complete listing of all the genes and ESTs with at least a three-fold change in expression is shown in Table 7. Table 7A contains those genes and ESTs whose expression level increased in hepatocellular carcinoma tissue relative to normal tissue and Table 7B contains those genes and ESTs whose expression level decreased.

Analysis of sample set identified 24 ESTs and 42 genes that are expressed in both metastatic liver tumors and hepatocellular carcinomas, but not in normal liver tissues. The fifteen genes with the most increase in expression level in both types of cancer are shown in Table 5. Expression levels were determined by comparing the mean expression values of individual genes in tumor and normal liver samples. The mean expression value for HCC and metastatic carcinomas was greater than 250, and included only those genes that showed a fold change greater than 3 with significant p values for both sets of tumors. No detectable level of expression was found in the normal liver tissues for these genes. Only the characterized genes have been listed; the ESTs with similar fold changes that are unique to the tumors are not presented here.

Differential gene expression patterns between normal liver samples and hepatocellular carcinomas and between normal livers and metastatic liver tumors were examined. Genes uniquely expressed by each of the groups individually were identified, as well as those genes that are commonly expressed among liver tumors, whether primary hepatocellular carcinomas or metastatic liver tumors.

Example 6

Association of Liver Cancer with Specific Gene Expression

The present inventors have closely examined a number of the tumor-expressing genes to determine if their expression patterns correlate with previous reports published in the literature, and to define a logical relationship between the gene and hepatocarcinogenesis. A number of genes that have previously been associated with either liver cancer or other types of cancers were identified, as well as numerous genes that have not been linked to cancers in any previous studies.

842 genes and ESTs that are up-regulated in hepatocellular carcinomas were identified when compared with normal liver tissue. One such gene is PTTG1, pituitary tumor-transforming gene 1, or securin, an oncogene that inhibits sister chromatid separation during anaphase. Normal tissues show little or no PTTG1 expression, but high levels of expression have been associated with various tumors, including liver tumors, and carcinoma cell lines. Overexpression in NIH3T3 cells resulted in transformation, and these cells caused the formation of tumors when injected into mice. The mechanism by which this tumorigenic activity takes place is postulated to be through the missegregation of sister chromatids, resulting in aneuploidy and, therefore, genetic instability. Our data further support this overexpression of PTTG1 in hepatocellular carcinoma, with a fold change of 10.7 (P=0.00052), and no detectable level of expression in normal tissues, as identified by the differential comparison of the consensus patterns of gene expression of these two sample sets.

Galectin 3, LGALS3, one of a family of beta-galactoside-binding animal lectins, is significantly overexpressed both in primary hepatocellular carcinoma and metastatic liver carcinomas with fold changes of 6.8 (P=0.00103) and 27.1 (P=0.00001), respectively. Expression of LGALS3 has been associated with tumor growth, progression, and metastasis, as well as cell-cell and cell-matrix interactions and inflammatory processes. Although expression studies have revealed no detectable level of galectin-3 in normal liver cells, samples from patients with hepatocellular carcinoma revealed considerable levels of LGALS3 expression. The abnormal expression of this lectin may be an early event in the process of transformation of normal cells to tumor cells, or it may impart an increased capacity for these tumor cells to survive and proliferate. Consistent with the reports in the art, an increased expression level was found in both types of tumor, but higher concentrations of galectin-3 were observed in liver metastates from colorectal tumors than in the primary HCC tumors.

Another gene that is overexpressed in both hepatocellular carcinoma and metastatic colorectal adenocarcinomas with fold changes of 12.2 (P=0.00169) and 58.0 (P=0.00063), respectively, is solute carrier family 2, member 3, or glucose transporter 3 (GLUT3). It is one of a family of transmembrane proteins that function as facilitative glucose transporters, which has a unique specificity for brain and neuronal tissues. Glucose uptake and metabolism are known to be increased in carcinoma cells compared to normal cells. Glucose transporter expression may be elevated in response to the increase in glucose utilization seen in actively proliferating cells, like those of tumors. Conversely, the high levels of glucose transporter expression may be responsible for the enhanced influx of glucose into the tumor cells. Various reports have indicated increased expression of one or more of the family of glucose transporters in malignancies, including those of the brain, esophagus, colon, pancreas, liver, breast, lung, bladder, ovary, testis, skin, head and neck, kidney, and gastric tumors. It has been reported that metastatic liver carcinomas have even higher levels of GLUT3 expression than primary tumors. Consistent with previous studies, the current data confirm the significant overexpression of GLUT3 both in primary liver cancer, hepatocellular carcinoma, and in tumors that have metastasized from the colon and rectum.

One of the significantly underexpressed genes identified by comparing the expression profiles of hepatocellular carcinomas and metastatic liver tumors with that of normal liver tissue is metallothionein 1L. The expression level in HCC is 26.9 fold lower than that of normal (P=0.00999), and in metastatic colorectal adenocarcinomas it is down-regulated 66.5 fold (P=0.00415). Metallothioneins are heavy metal binding proteins that are involved in detoxification of metals, zinc and copper metabolism cellular adaptation mechanisms, and may be involved in regulating apoptosis. Colorectal adenocarcinoma that has metastasized to the liver has been specifically reported to express less metallothionein than normal liver tissue. Comparison of the consensus patterns of gene expression between metastatic liver samples and normal liver samples show no significant level of MT1L expression in the tumors. Furthermore, additional work has determined that human hepatocellular carcinomas contain much lower levels of metallothioneins than normal liver tissue, and that this decrease correlates with the degree of differentiation and concentrations of copper and zinc in the cells. By comparing the expression profiles of hepatocellular carcinoma and normal liver tissue, this significant reduction in MT1L expression in HCC was confirmed.

A number of enzymes belonging to the family of cytochrome P450s are drastically underexpressed in the two sets of liver tumors in comparison with the normal liver tissue.

For example, expression of CYP2A6 is decreased in HCC with a fold change of 14.2 (P=0.0307), and in metastatic tumors with a fold change of 69.9 (P=O). CYP8B 1 is down-regulated 19.3 fold (P=0.00807) in HCC and 65.1 fold (P=0.0039) in liver metastases. In addition to these commonly down-regulated cytochrome P450s, in HCC samples CYP2B is underexpressed 17.9 fold (P=0.01469), and in the metastatic liver tumors CYP2C9 and CYP2A7 are underexpressed 84.7 fold (P=0.00327) and 72.0 fold (P=0), respectively. Several of these genes are also identified by the differential comparison between expression profiles of tumor and normal, confirming the significant decrease in expression in tumor tissues. Many of these P450 enzymes are critical players in the metabolism of carcinogens, drugs, and other chemical compounds, that are expressed in normal liver.

In addition to genes that are underexpressed in metastatic adenocarcinomas in the liver, more than 1000 genes and ESTs that are overexpressed specifically in these tumors were identified. Two of the most highly up-regulated are claudin 4, also known as clostridium perfringens enterotoxin receptor 1 (fold change 84.4, P=0) and occludin (fold change 43.1, P=0). Both of these genes are tight junction proteins, responsible for the formation and maintenance of continuous seals around epithelial cells to form a physical barrier that blocks the free passage of water and solutes through the paracellular space. More specifically, claudin-4 is one member of a family of transmembrane proteins that comprise tight junction strands, and occludin is a cell adhesion molecule. Claudins likely function as paracellular channels, regulating the flow of ions and solutes into and out of the paracellular space. Tight junction proteins also contribute to the regulation of the cellular processes of cell growth and differentiation. Permeability of tight junctions has been associated with tumor formation, where a breakdown in the barrier function of tight junctions allows an increase in the cellular permeability. This breakdown then opens the tight junction barrier, permitting invasion by tumor cells. It has been reported that tight junctions of colon tumors leak more than do the tight junctions of normal colon. A complete loss of tight junction function and a loss of cell-cell contact growth control has been seen in cells that had been transfected with oncogenic Raf-1, and expression levels of occludin and another claudin are lower in these cells. Occludin expression has been up-regulated in vitro by the addition of various fatty acids that have anti-cancer effects, decreasing the paracellular permeability. The extreme down-regulation of occludin and claudin-4 in metastatic liver tumors is strongly supported by the reports of tight junction breakdown in tumor tissues.

The present study identified 93 significantly up-regulated genes in both primary HCC and metastatic liver tumors that were not found to have any detectable level of expression in the normal samples. Serine protease inhibitor, Kazal type I (SPINK1), also called pancreatic secretory trypsin inhibitor (PSTI) or tumor-associated trypsin inhibitor (TATI), is one such gene. It is highly expressed in the cells of normal pancreas and in the mucosa of the gastrointestinal tract where it offers protection from proteolytic breakdown. A marked increase in expression is seen in various pancreatic diseases and in tumors of different tissues, including gastric carcinomas, colorectal cancers, and other neoplastic tissues. This increase is presumably due to the elevated expression of trypsin in the tumors, and not related to amplification or rearrangements within the gene. SPINK1 is also considered a valuable marker for a number of solid tumors. An elevation of SPINK1 in the blood of patients with hepatocellular carcinoma has been seen. Furthermore, they suggest that the level of expression correlates with the extent of tumor, such that this heightened expression level could be indicative of HCC under certain conditions. In keeping with this report of overexpression in these tumors, the present expression data show the levels of expression of this gene in HCC samples to be 28.9 times higher than normal (P=0.00003), and in metastatic liver tumors the expression level is 9.8 times higher than normal (P=0.03697).

Midkine is one of a family of heparin-binding growth factors, inducible by retinoic acid, and is actively involved in cell-cell interactions and angiogenesis. The expression pattern of midkine is highly restricted in normal adult tissues, and no expression has been reported in normal adult liver, although its expression is required during embryogenesis for normal development. However, it is expressed in moderate to high levels in many tumors, including Wilm's tumors of the kidney, stomach, colon, pancreas, lung, esophagus, breast, and liver tumors. The present data confirm these reports, showing a significant overexpression of midkine in hepatocellular carcinoma samples (fold change 9.9, P=0.02104) and in liver metastases (fold change 10.4, P=0.01818), but no noticeable expression in normal liver.

Stathmin, leukemia-associated phosphoprotein 18, is a phosphoprotein whose expression pattern and phosphorylation status are controlled by extracellular signals responsible for the regulation of the processes of cell proliferation and differentiation. It is also involved in the regulation of cell division via the destabilization of microtubules. When comparing expression levels between non-malignant tissues and malignant tissues, the tumors generally show a significant up-regulation of this phosphoprotein, specifically lymphomas, leukemias, breast and prostate tumors. One reason proposed for this elevated expression in cancer cells is the dissimilarity in the rates of cell proliferation and states of differentiation between normal and tumor cells. In both HCC samples and metastatic adenocarcinomas, significant up-regulation of stathmin, 9.4 fold in HCC (P=0.00015) and 4.8 fold in metastatic tumors (P=0.005 14) was seen.

Both the genes and ESTs described here will provide valuable information for the identification of new drug targets against liver carcinomas, and that information may be extended for use in the study of carcinogenesis in other tissues. These sequences may be used in the methods of the invention or may be used to produce the probes and arrays of the invention.

Although the present invention has been described in detail with reference to examples above, it is understood that various modifications can be made without departing from the spirit of the invention. Accordingly, the invention is limited only by the following claims. All cited patents, applications and publications referred to in this application are herein incorporated by reference in their entirety.

TABLE 1

Clinical Information for Hepatocellular Carcinoma, Metastatic Liver Tumor, and Normal Liver Samples Included in this Study

| Sample | Pathology | Primary Tumor | Age | Gender | Race | TNM Classification | Histopathologic Grade | Clinical Stage |
|---|---|---|---|---|---|---|---|---|
| HCC1 | Hepatocellular Carcinoma | Liver | 64 | Male | Caucasian | T3, Nx, Mx | G2 | stage III |
| HCC2 | Hepatocellular Carcinoma | Liver | 27 | Female | Caucasian | T3, N0, Mx | G1 | stage III |
| HCC3 | Hepatocellular Carcinoma | Liver | 78 | Female | Caucasian | T4, Nx, Mx | G2 | stage III |
| HCC4 | Hepatocellular Carcinoma | Liver | 43 | Male | Asian | T4, N1, Mx | G2 | stage IV |
| HCC5 | Hepatocellular Carcinoma | Liver | 51 | Male | Caucasian | T4, N0, Mx | G2 | stage IV |
| HCC6 | Hepatocellular Carcinoma | Liver | 57 | Male | Caucasian | unavailable | G2 | stage III |
| M1 | Metastatic Adenocarcinoma | Rectum | 61 | Female | Caucasian | Tx, Nx, M1 | G3 | stage IV; Duke D |
| M2 | Metastatic Adenocarcinoma | Colon | 54 | Male | Caucasian | unavailable | G2 | stage IV; Duke D |
| M3 | Metastatic Adenocarcinoma | Rectum | 50 | Female | Caucasian | Tx, Nx, M1 | G2 | stage IV; Duke D |
| M4 | Metastatic Adenocarcinoma | Colon | 60 | Male | Caucasian | Tx, Nx, M1 | G2 | stage IV; Duke D |
| M5 | Metastatic Adenocarcinoma | Colon | 57 | Male | Caucasian | Tx, Nx, M1 | G2 | stage IV; Duke D |
| N1 | Normal liver | | 54 | Female | Caucasian | | | |
| N2 | Normal liver | | 55 | Female | Caucasian | | | |
| N3 | Normal liver | | 58 | Male | Caucasian | | | |
| N4 | Normal liver | | 44 | Female | Caucasian | | | |
| N5 | Normal liver | | 40 | Female | Caucasian | | | |
| N6 | Normal liver | | 72 | Female | Caucasian | | | |
| N7 | Normal liver | | 48 | Female | Unknown | | | |
| N8 | Normal liver | | 55 | Female | Caucasian | | | |

TABLE 2

Summary of Genes and ESTs Expressed in HCC, Metastatic Liver Tumors, and Normal Livers

| | Hepatocelluar Carcinoma | Colorectal Metastases | Normal Livers |
|---|---|---|---|
| I. Fingerprint of Gene Expression | | | |
| Genes and ESTs commonly expressed in sample set | 8479 | 5102 | 6213 |
| Genes and ESTs commonly unexpressed in sample set | 23233 | 30455 | 24900 |
| II. Fold Change | | | |
| Genes and ESTs overexpressed in tumors (fold change >3 and p < 0.05) | 842 | 1044 | |
| Number of Genes | 430 | 603 | |
| Number of ESTs | 412 | 441 | |
| Genes and ESTs underexpressed in tumors (fold change >3 and p < 0.05) | 393 | 1867 | |
| Number of Genes | 235 | 1016 | |
| Number of ESTs | 158 | 851 | |
| III. Differential Comparison between Normal and Tumor Expression | | | |
| Genes and ESTs turned ON in tumors | 243 | 296 | |
| Genes and ESTs with expression level above threshold in tumor | 77 | 155 | |
| Number of Genes | 38 | 83 | |
| Number of ESTs | 39 | 72 | |
| Genes and ESTs turned OFF in tumors | 47 | 903 | |
| Genes and ESTs with expression level above threshold in normal | 23 | 449 | |
| Number of Genes | 13 | 289 | |
| Number of ESTs | 10 | 160 | |

Table 3A

Top Fifteen Genes Overexpressed in Hepatocellular Carcinoma

| Accession # | SEQ ID: | Unigene Cluster | Gene Name | Fold Change | Pvalue |
|---|---|---|---|---|---|
| N33920 | 2492 | Hs.44532 | diubiquitin | 50.3 | 0 |
| Y00705 | 3847 | Hs.181286 | serine protease inhibitor, Kazal type 1 | 28.9 | 0.00003 |
| AA610116 | 1499 | Hs.102737 | tetraspan NET-6 protein | 16.4 | 0.00249 |
| AA505133 | 1417 | Hs.279905 | solute carrier family 2 (facilitated glucose transporter), member 3 | 12.2 | 0.00169 |
| AA055896 | 135 | Hs.146428 | collagen, type V, alpha 1 | 10.9* | 0.00907 |
| AA430032 | 1009 | Hs.252587 | pituitary tumor-transforming 1 | 10.7* | 0.00052 |
| Z37987 | 3879 | Hs.119651 | glypican 3 | 10.7 | 0.02304 |
| J03464 | 2094 | Hs.179573 | collagen, type I, alpha 2 | 10.4 | 0.00979 |
| W45320 | 3520 | Hs.228059 | KRAB-associated protein 1 | 10.1* | 0.00002 |
| M94250 | 2425 | Hs.82045 | midkine (neurite growth-promoting factor 2) | 9.9* | 0.02104 |

Table 3A-continued

Top Fifteen Genes Overexpressed in Hepatocellular Carcinoma

| Accession # | SEQ ID: | Unigene Cluster | Gene Name | Fold Change | Pvalue |
|---|---|---|---|---|---|
| AA428172 | 986 | Hs.8546 | Notch (Drosophila) homolog 3 | 9.6* | 0.00195 |
| AA620881 | 1510 | Hs.21858 | trinucleotide repeat containing 3 | 9.5 | 0.00062 |
| D51276 | 1678 | Hs.81915 | leukemia-associated phosphoprotein p18 (stathmin) | 9.4 | 0.00015 |
| AA156187 | 399 | Hs.81634 | ATP synthase, H+ transporting, mitochondrial F0 complex subunit b, isoform 1 | 9.4 | 0.02007 |
| D31094 | 1639 | Hs.109798 | G8 protein | 9.4 | 0.0048 |

TABLE 3B

Top Fifteen Genes that are Underexpressed in Hepatocellular Carcinoma

| Accession # | SEQ ID: | Unique Cluster | Gene Name | Fold Change | Pvalue |
|---|---|---|---|---|---|
| HB1070 | 2006 | Hs.8765 | RNA helicase-related protein | 39.6 | 0.00002 |
| AA007395 | 17 | Hs.1219 | alcohol dehydrogenase 4 (class II), pi polypeptide | 37.8 | 0.00939 |
| T48075 | 3129 | Hs.251577 | hemoglobin, alpha 1 | 35.8 | 0.00471 |
| N80129 | 2702 | Hs.94360 | metallothionein 1 L | 26.9 | 0.00999 |
| AA010605 | 26 | Hs.2899 | 4-hydroxyphenylpyruvate dioxygenase | 25.5 | 0.00855 |
| W88946 | 3636 | Hs.18508 | putative glycine-N-acyltransferase | 25.3 | 0.00221 |
| T95813 | 3261 | Hs.137476 | KIAA1051 protien | 20.4 | 0.01361 |
| H58692 | 1960 | Hs.9520 | formyltetrahydrofolate dehydrogenase | 20.2 | 0.00485 |
| R97419 | 3003 | Hs.35718 | cyctochrome P450, subfamily VIIIB (sterol 12-alpha-hydroxylase), polypeptide 1 | 19.3 | 0.00807 |
| H80901 | 2005 | Hs.272576 | ficolin (collagen/fibrinogen domain-containing) 3 (Hakata antigen) | 18.6 | 0 |
| M29873 | 2318 | Hs.1360 | cytochrome P450, subfamily IIB (phenobarbital-inducible) | 17.9 | 0.01469 |
| U56814 | 3392 | Hs.88646 | deoxyribonuclease I-like 3 | 17.7 | 0.00007 |
| T67931 | 3183 | Hs.7645 | fibrinogen, B beta polypeptide | 17.3 | 0.00128 |
| K03192 | 2127 | Hs/183584 | cytochrome P450, subfamily IIA (phenobarbital-inducible), polypeptide 6 | 14.2 | 0.0307 |
| AA448002 | 1113 | Hs.23759 | putative type II membrane protein | 14.1* | 0 |

TABLE 4A

Top Fifteen Genes Overexpressed in Metastatic Carcinomas in the Liver

| Accession # | SEQ ID: | Unigene Cluster | Gene Name | Fold Change | Pvalue |
|---|---|---|---|---|---|
| AA427468 | 973 | Hs.5372 | Claudin 4 | 84.4* | 0 |
| H58873 | 1961 | Hs.169902 | Solute carrier family 2 (facilitated glucose transporter), member 3 | 58.0* | 0.00063 |
| AA421562 | 934 | Hs.91011 | Anterior gradient 2 (Xenopus leavis) homolog | 56.3* | 0.0041 |
| AA100719 | 212 | Hs.73848 | Carcinoembroyonic antigne-related cell adhesion molecule 6 (non-specific cross reacting antigen) | 50.9* | 0.00081 |
| AA335191 | 741 | Hs.173724 | Creatine kinase, brain | 47.4* | 0.00419 |
| H95233 | 2048 | Hs.31439 | Serine protease inhibitor, Kunitz type 2 | 47.1 | 0 |
| H94471 | 2042 | Hs.171952 | Occludin | 43.1 | 0 |
| X93036 | 3827 | Hs.92323 | FXYD domain-containing ion transport reglator 3 | 42.4* | 0.00167 |
| AA156243 | 340 | Hs.154737 | Serine protease, umbillcal endothelium | 41.4* | 0.00139 |
| M35252 | 2343 | Hs.84072 | Transmembrane 4 superfamily membrane 3 | 39.1 | 0 |
| M29540 | 2317 | Hs.220529 | Carcinoembryonic antigen-related cell adhesion molecule 5 | 36.6* | 0.0116 |
| N92934 | 2724 | Hs.17409 | Cysteine-rich protein 1 (intestinal) | 35.5 | 0.002 |
| AA610116 | 1149 | Hs.102737 | Tetraspan NET-6 protein | 33.7 | 0.00171 |
| HG2788-HT2896 | | Hs.27258 | Calycyclin binding protein | 33.2 | 0 |
| AA429009 | 994 | Hs.233950 | Serine protease inhibitor, Kunitz type 1 | 30.0* | 0.00001 |

TABLE 4B

Top Fifteen Genes that are Underexpressed in Metastatic Carcinomas in the Liver

| Accession # | SEQ ID: | Unigene Cluster | Gene Name | Fold Change | Pvalue |
|---|---|---|---|---|---|
| N54417 | 2566 | Hs.90765 | Fibrinogen, A alpha polypeptide | 99.3 | 0.00001 |
| N53031 | 2555 | Hs.89691 | UDP glycosyltransferase 2 family, polypeptide B4 | 97.6 | 0.00022 |

TABLE 4B-continued

Top Fifteen Genes that are Underexpressed in Metastatic Carcinomas in the Liver

| Accession # | SEQ ID: | Unigene Cluster | Gene Name | Fold Change | Pvalue |
|---|---|---|---|---|---|
| M15656 | 2268 | Hs.234234 | Aldolase B, fructose-bisphosphate | 96.7* | 0 |
| T59148 | 3157 | Hs.550966 | Carbamoyl-phosphate synthetase 1, mitochondrial | 88.9* | 0 |
| R49459 | 2881 | Hs.63758 | Transferrin receptor 2 | 85.6 | 0.00048 |
| X55283 | 3731 | Hs.1259 | Asialoglycoprotein receptor 2 | 85.0 | 0.00084 |
| L16883 | 2166 | Hs.167529 | Cytochrome P450, subfamily IIC (menphenytoin 4-hydroxylase), polypeptide 9 | 84.7 | 0.00327 |
| T48039 | 3128 | Hs.2351 | Protien C (inactivator of coagulation factors Va and VIIIa) | 84.4 | 0.00112 |
| H58692 | 1960 | Hs.9520 | Formyltetrahydrofolate dehydrogenase | 81.4* | 0 |
| M81349 | 2404 | Hs.1955 | Serum amyloid A4, constitutive | 76.2 | 0.00015 |
| R43174 | 2847 | Hs.1898 | Paraoxonase 1 | 74.0* | 0.00038 |
| M16594 | 2272 | Hs.89552 | glutathione S-transferase A2 | 73.2* | 0 |
| U22029 | 3326 | Hs.250615 | Cytochrome P450, subfamily IIA (phenobarbital-inducible), polypeptide 7 | 72.0* | 0 |
| AA256367 | 579 | Hs.107966 | Paraoxonase 3 | 70.3 | 0.00192 |
| K03192 | 2127 | Hs.183584 | Cytochrome P450, subfamily IIA (phenobarbital-inducible), polypeptide 6 | 69.9* | 0 |

TABLE 5

Top Fifteen Genes Expressed in Both Hepatocellular Carcinomas and Metastatic Liver Tumors, not in Normal Liver Tissue

| Accession # | SEQ ID: | Unigene Cluster | Gene Name | HCC Fold Change | HCC p value | Metastatics Fold Change | Metastatic p value |
|---|---|---|---|---|---|---|---|
| Y00705 | 3847 | Hs.181286 | serine protease inhibitor, Kazal type 1 | 28.9 | 0.00003 | 9.8 | 0.03697 |
| AA610116 | 1499 | Hs.102737 | tetraspan NET-6 protein | 16.4 | 0.00249 | 33.7 | 0.00171 |
| AA055896 | 135 | Hs.146428 | collagen, type V, alpha 1 | 10.9 | 0.00907 | 18.2 | 0.00146 |
| J03464 | 2094 | Hs.179573 | collagen, type I, alpha 2 | 10.4 | 0.00979 | 9.8 | 0.00028 |
| M94250 | 2425 | Hs.82045 | midkine (neurite growth-promoting factor 2) | 9.9 | 0.02104 | 10.4 | 0.01818 |
| AA620881 | 1510 | Hs.21858 | trinucleotide repeat containing 3 | 9.5 | 0.00062 | 8.7 | 0.00735 |
| D51276 | 1678 | Hs.81915 | leukemia-associated phosphoprotein p18 (stathmin) | 9.4 | 0.00015 | 4.8 | 0.00514 |
| D31094 | 1639 | Hs.109798 | G8 protein | 9.4 | 0.0048 | 4.4 | 0.04845 |
| AA429472 | 997 | Hs.236522 | DKFZP434P106 protein | 8.8 | 0.00063 | 8.3 | 0.00208 |
| AA452724 | 1149 | Hs.166468 | programmed cell death 5 | 7.7 | 0.00085 | 7.2 | 0.00908 |
| D26129 | 1635 | Hs.78224 | ribonuclease, RNase A family, 1 (pancreatic) | 6.9 | 0.00008 | 5.7 | 0.03827 |
| AA434418 | 1036 | Hs.72172 | KIAA1115 protein | 6.8 | 0.0032 | 5.1 | 0.00498 |
| AA335191 | 741 | Hs.173724 | creatine kinase, brain | 6.5 | 0.01462 | 47.4 | 0.00419 |
| AA204927 | 425 | Hs.77899 | tropomyosin 1 (alpha) | 6.1 | 0.0014 | 7.1 | 0.00074 |
| H27188 | 1908 | Hs.9930 | collagen-binding protein 2 (colligen 2) | 5.8 | 0.01826 | 4.2 | 0.02073 |

TABLE 6A

Up in Metastatics vs Normal Sample Set 2

| Fragment Name | SEQ ID: | Known Gene Name | Fold Change | Direction | Pvalue |
|---|---|---|---|---|---|
| AA427468 | 973 | claudin 4 | 84.43 | up | 0 |
| H58873 | 1961 | solute carrier family 2 (facilitated glucose transporter), member 1 | 57.98 | up | 0.00063 |
| AA421562 | 934 | anterior gradient 2 (Xenepus laevis) homolog | 56.3 | up | 0.0041 |
| J04423 | 2109 | EST | 54.11 | up | 0.02774 |
| AA100719 | 212 | carcinoembryonic antigen-related cell adhesion molecule 6 (non-specific cross reacting antigen) | 50.88 | up | 0.00081 |
| AA159525 | 354 | EST | 49.39 | up | 0.00062 |
| J04423 | 2109 | EST | 48.05 | up | 0.02203 |
| AA335191 | 741 | creatine kinase, brain | 47.35 | up | 0.00419 |
| H95233 | 2048 | serine protease inhibitor, Kunitz type, 2 | 47.06 | up | 0 |
| N22015 | 2447 | EST | 46.61 | up | 0.00025 |
| M18728 | 2285 | carcinoembryonic antigen-related cell adhesion molecule 6 (non-specific cross reacting antigen) | 44.82 | up | 0.00291 |
| AA211483 | 435 | EST | 44.07 | up | 0.00175 |
| H94471 | 2042 | occludin | 43.09 | up | 0 |
| N54841 | 2571 | EST | 42.96 | up | 0.00002 |
| AA055805 | 132 | EST | 42.83 | up | 0.00142 |
| X93036 | 3827 | FXYD domain-containing ion transport regulator 3 | 42.36 | up | 0.00167 |
| AA156243 | 340 | serine protease, umbilical endothelium | 41.44 | up | 0.00139 |
| R33498 | 2819 | EST | 41.34 | up | 0.00001 |
| AA291168 | 696 | EST | 40.67 | up | 0.00065 |
| M35252 | 2343 | transmembrane 4 superfamily member 3 | 39.12 | up | 0 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| AA398908 | 801 | EST | 38.69 | up | 0.01089 |
| AA424487 | 945 | EST | 38.41 | up | 0.00002 |
| M29540 | 2317 | carcinoembryonic antigen-related cell adhesion molecule 5 | 36.57 | up | 0.0116 |
| N92934 | 2724 | cysteine-rich protein 1 (intestinal) | 35.52 | up | 0.002 |
| AA075299 | 164 | EST | 34.27 | up | 0.00002 |
| AA610116 | 1499 | tetraspan NET-6 protein | 33.68 | up | 0.00171 |
| HG2788-HT2896 | | calcyclin binding protein | 33.15 | up | 0 |
| W92449 | 3649 | EST | 31.67 | up | 0.00011 |
| T26366 | 3092 | EST | 30.43 | up | 0.00153 |
| AA429009 | 994 | serine protease inhibitor, Kunitz type I | 30.04 | up | 0.00001 |
| AA099404 | 208 | EST | 29.07 | up | 0 |
| AA011134 | 29 | EST | 28.79 | up | 0.00602 |
| W72276 | 3580 | EST | 27.39 | up | 0.00183 |
| M57710 | 2357 | lectin, galactoside-binding, soluble, 3 (galectin 3) | 27.12 | up | 0.00001 |
| AA053102 | 125 | cadherin 17, LI cadherin (liver-intestine) | 26.63 | up | 0.01745 |
| W95477 | 3661 | EST | 26.51 | up | 0.00161 |
| M27826 | 2313 | endogenous retroviral protease | 26.36 | up | 0.00342 |
| AA157818 | 349 | endogenous retroviral protease | 25.99 | up | 0.00153 |
| A372630 | 769 | differentially expressed in hematopoietic lineages | 25.49 | up | 0.01743 |
| T03580 | 3045 | pyruvate kinase, muscle | 24.91 | up | 0.0001 |
| AA463861 | 1251 | EST | 24.79 | up | 0.00096 |
| AA101551 | 216 | EST | 24.78 | up | 0 |
| AA284879 | 679 | EST | 24.68 | up | 0.00001 |
| AA213696 | 437 | poly(A)-binding protein, cytoplasmic 1 | 24.65 | up | 0.00001 |
| AA394121 | 778 | laminin receptor 1 (67kD, ribosomal protein SA) | 23.78 | up | 0.00099 |
| AA234096 | 479 | EST | 23.72 | up | 0.00018 |
| AA156187 | 339 | ATP synthase, H+ transporting, mitochondrial FO complex, subunit b, isoform 1 | 23.24 | up | 0.00006 |
| X56494 | 3735 | pyruvate kinase, muscle | 22.97 | up | 0.00001 |
| F09394 | 1803 | K1AA0715 protein | 22.89 | up | 0.01753 |
| M94345 | 2426 | capping protein (actin filament), gelsolin-like | 22.38 | up | 0.00003 |
| AA428964 | 993 | kallikrein 10 | 21.83 | up | 0.02324 |
| J04423 | 2109 | EST | 21.46 | up | 0.04283 |
| L08044 | 2149 | trefoil factor 3 (intestinal) | 21.42 | up | 0.01674 |
| AA405791 | 864 | EST | 21.22 | up | 0 |
| LI7131 | 2168 | high-mobility group (nonhistone chromosomal) protein isoforms I and Y | 20.57 | up | 0.00058 |
| AA233959 | 477 | EST | 19.69 | up | 0.00101 |
| AA427636 | 976 | EST | 19.23 | up | 0.00145 |
| U78095 | 3429 | serine protease inhibitor, Kunitz type, 2 | 18.85 | up | 0 |
| AA161043 | 356 | tetraspan 1 | 18.8 | up | 0.00015 |
| D38583 | 1656 | S100 calcium-binding protein A11 (calgizzarin) | 18.7 | up | 0.00003 |
| AA055896 | 135 | collagen, type V, alpha 1 | 18.16 | up | 0.00146 |
| AA143763 | 311 | EST | 18.09 | up | 0.00347 |
| AA171760 | 367 | EST | 17.86 | up | 0 |
| H18442 | 1891 | creatine kinase, brain | 17.42 | up | 0.02391 |
| AA422150 | 939 | cytochrome P540 family member predicted from ESTs | 17.14 | up | 0.00108 |
| AA158234 | 351 | EST | 17.04 | up | 0.00711 |
| AA442054 | 1067 | phospholipase C, gamma 1 (formerly subtype 148) | 16.89 | up | 0.00205 |
| AA430032 | 1009 | pituitary tumor-transforming 1 | 16.87 | up | 0.00659 |
| AA251299 | 541 | KIAA0014 gene product | 16.86 | up | 0.00046 |
| AA331393 | 739 | EST | 16.73 | up | 0.00848 |
| W93726 | 3653 | protease inhibitor 5 (maspin) | 16.48 | up | 0.00014 |
| M93036 | 2421 | membrane component, chromosomal 4, surface marker (35kD glycoprotein) | 16.45 | up | 0.00308 |
| AA411502 | 889 | EST | 16.42 | up | 0.00241 |
| AA410508 | 885 | EST | 16.04 | up | 0.02635 |
| AA053660 | 128 | EST | 15.98 | up | 0.00003 |
| N98464 | 2743 | EST | 15.95 | up | 0.00004 |
| AA215299 | 439 | U6 snRNA-associated Sm-like protein LSm7 | 15.84 | up | 0.00001 |
| M27830 | 2314 | EST | 15.53 | up | 0.00022 |
| AA131919 | 270 | putative type II membrane protein | 15.36 | up | 0.00027 |
| T24068 | 3087 | EST | 15.26 | up | 0.00046 |
| AA253473 | 567 | EST | 15.23 | up | 0.00171 |
| W42957 | 3513 | calmodulin 2 (phosphorylase kinase, delta) | 15.22 | up | 0.00007 |
| AA430674 | 1018 | EST | 15.11 | up | 0.00293 |
| M38591 | 2350 | S100 calcium-binding protein A10 (annexin II ligand, calpactin I, light polypeptide (p 11)) | 14.87 | up | 0 |
| M27830 | 2314 | EST | 14.86 | up | 0.00043 |
| AA485697 | 1346 | EST | 14.74 | up | 0.00102 |
| AA451676 | 1135 | EST | 14.72 | up | 0.00056 |
| X68314 | 3775 | glutathione peroxidase 2 (gastrointestinal) | 14.4 | up | 0.00222 |
| AA372018 | 768 | EST | 14.3 | up | 0.00178 |
| AA135894 | 295 | retinoic acid induced 3 | 14.27 | up | 0.00558 |
| Y00503 | 3846 | keratin 19 | 14.19 | up | 0.00217 |
| L08044 | 2149 | trefoil factor 3 (intestinal) | 14.18 | up | 0.02124 |
| AA161292 | 357 | interferon, alpha-inducible protein 27 | 13.84 | up | 0.00004 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| AA412405 | 901 | EST | 13.82 | up | 0.01021 |
| C01766 | 1559 | EST | 13.67 | up | 0.00003 |
| AA262943 | 611 | EST | 13.42 | up | 0.00234 |
| U09770 | 3295 | cysteine-rich protein 1 (intestinal) | 13.03 | up | 0.0072 |
| AA227560 | 458 | EST | 12.81 | up | 0.01693 |
| M16364 | 2269 | creatine kinase, brain | 12.69 | up | 0.03633 |
| X57348 | 3741 | stratifin | 12.53 | up | 0.0013 |
| AA429890 | 1004 | cisplatin resistance associated | 12.51 | up | 0.00053 |
| J04164 | 2108 | interferon induced transmembrane protein 1(9-27) | 12.37 | up | 0.00001 |
| X65614 | 3764 | S100 calcium-binding protein P | 12.2 | up | 0.00065 |
| AA134968 | 289 | EST | 12.11 | up | 0.00079 |
| AA134985 | 290 | EST | 12.11 | up | 0.00318 |
| J05257 | 2118 | dipeptidase 1 (renal) | 12.02 | up | 0.02099 |
| T23490 | 3081 | EST | 11.86 | up | 0.03242 |
| N49284 | 2536 | v-myb avian myeloblastosis viral oncogene homolog | 11.82 | up | 0.01981 |
| X76180 | 3792 | sodium channel, nonvoltage-gated 1 alpha | 11.68 | up | 0 |
| AA290674 | 692 | eukaryotic translation initiation factor 4E binding protein 1 | 11.59 | up | 0.00036 |
| M10098 | 2231 | EST | 11.55 | up | 0.00099 |
| AA447687 | 1104 | EST | 11.42 | up | 0.00362 |
| D00017 | 1587 | annexinA2 | 11.38 | up | 0 |
| H20989 | 1899 | pyruvate kinase, muscle | 11.37 | up | 0.0375 |
| AF003521 | 1545 | jagged 2 | 11.26 | up | 0.00008 |
| AA126044 | 245 | EST | 11.23 | up | 0.00041 |
| R95966 | 2996 | EST | 11.22 | up | 0.00682 |
| AA256642 | 582 | EST | 11.17 | up | 0.00035 |
| AA497031 | 1407 | EST | 11.05 | up | 0.04381 |
| R92994 | 2989 | matrix metalloproteinase 12 (macrophage elastase) | 11.05 | up | 0.00248 |
| L33842 | 2197 | IMP (inosine monophosphate) dehydrogenase 2 | 11.03 | up | 0.00001 |
| AA026030 | 53 | EST | 11.01 | up | 0.01649 |
| R49476 | 2882 | EST | 10.95 | up | 0.00014 |
| AA404338 | 849 | EST | 10.9 | up | 0.00668 |
| W95348 | 3660 | HSPC113 protein | 10.89 | up | 0.01065 |
| M12125 | 2241 | tropomyosin 2 (beta) | 10.83 | up | 0.00191 |
| U07969 | 3288 | cadherin 17, LI cadherin (liver-intestine) | 10.78 | up | 0.02002 |
| AA338889 | 745 | actin related protein 2/3 complex, subunit 4 (20 kD) | 10.77 | up | 0.03782 |
| AA460017 | 1225 | EST | 10.76 | up | 0.00106 |
| K03195 | 2128 | solute carrier family 2 (facilitated glucose transporter), member 1 | 10.73 | up | 0.00139 |
| AA422086 | 938 | EST | 10.71 | up | 0.03418 |
| T53404 | 3142 | EST | 10.68 | up | 0.00582 |
| M27830 | 2314 | EST | 10.64 | up | 0.00213 |
| AA113149 | 226 | tumor suppressing subtransferable candidate 3 | 10.58 | up | 0.00543 |
| X83228 | 3807 | cadherin 17, LI cadherin (liver-intestine) | 10.58 | up | 0.02147 |
| X12447 | 3693 | aldolase A, fructose-bisphosphate | 10.52 | up | 0.00038 |
| D51112 | 1675 | collapsin response mediator protein 1 | 10.48 | up | 0.00076 |
| Z74615 | 3946 | collagen, type I, alpha 1 | 10.47 | up | 0.00064 |
| AA429636 | 1001 | hexokinase 2 | 10.43 | up | 0.00597 |
| R71395 | 2951 | EST | 10.42 | up | 0.00422 |
| D83735 | 1747 | calponin 2 | 10.42 | up | 0.00001 |
| N31570 | 2485 | TNF receptor-associated factor 5 | 10.39 | up | 0.00018 |
| T95057 | 3258 | EST | 10.39 | up | 0.00003 |
| M94250 | 2425 | midkine (neurite growth-promoting factor 2) | 10.39 | up | 0.01818 |
| M10098 | 2231 | EST | 10.2 | up | 0.00027 |
| M24485 | 2304 | glutathione 5-transferase pi | 10.2 | up | 0.00003 |
| AA609013 | 1477 | dipeptidase 1 (renal) | 10.17 | up | 0.00109 |
| J03592 | 2096 | solute carrier family 25 (mitochondrial carrier; adenine nucleotide translocator) member 6 | 10.05 | up | 0 |
| AA001504 | 2 | EST | 9.98 | up | 0.00336 |
| H89551 | 2024 | EST | 9.94 | up | 0.00137 |
| AA608897 | 1473 | EST | 9.92 | up | 0.00087 |
| X89960 | 3815 | EST | 9.87 | up | 0 |
| Y00705 | 3847 | serine protease inhibitor, Kazal type 1 | 9.83 | up | 0.03697 |
| J03464 | 2094 | collagen, type I, alpha 2 | 9.81 | up | 0.00028 |
| M27830 | 2314 | EST | 9.8 | up | 0.00041 |
| AA132986 | 275 | EST | 9.72 | up | 0.00552 |
| X67325 | 3772 | interferon, alpha-inducible protein 27 | 9.67 | up | 0.03245 |
| AA280734 | 639 | KIAA0618 gene product | 9.64 | up | 0.00003 |
| N46423 | 2520 | EST | 9.64 | up | 0.00027 |
| T03313 | 3041 | dyskeratosis congenita 1, dyskerin | 9.63 | up | 0.00001 |
| AA188378 | 392 | EST | 9.56 | up | 0.00271 |
| AA428172 | 986 | Notch (Drosophila) homolog 3 | 9.53 | up | 0.02562 |
| AA454908 | 1171 | KIAA0144 gene product | 9.3 | up | 0.00539 |
| N39237 | 2510 | EST | 9.29 | up | 0.00001 |
| AA133936 | 284 | EST | 9.19 | up | 0.00088 |
| AA235707 | 500 | EST | 9.17 | up | 0.00005 |
| L33930 | 2198 | CD24 antigen (small cell lung carcinoma cluster 4 antigen) | 9.16 | up | 0.01252 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| H97013 | 2059 | ephrin-A4 | 9.14 | up | 0.00346 |
| AA084901 | 181 | ribosomal protein S6 kinase, 70kD, polypeptide 2 | 9.13 | up | 0.00003 |
| M38690 | 2351 | CD9 antigen (p24) | 9.08 | up | 0.00059 |
| W78057 | 3597 | EST | 9.06 | up | 0.0034 |
| N72116 | 2667 | solute carrier family 11 (proton-coupled divalent metal ion transporters), member 2 | 9.01 | up | 0.00051 |
| R91819 | 2983 | EST | 8.95 | up | 0.00009 |
| Z39191 | 3898 | EST | 8.84 | up | 0.00011 |
| AA116036 | 233 | chromosome 20 open reading frame 1 | 8.81 | up | 0.00133 |
| M27830 | 2314 | EST | 8.78 | up | 0.00003 |
| AA053424 | 127 | EST | 8.76 | up | 0.01775 |
| AA243173 | 526 | EST | 8.75 | up | 0.00003 |
| AA291139 | 695 | EST | 8.69 | up | 0.04573 |
| AA424029 | 943 | EST | 8.68 | up | 0.00081 |
| L09604 | 2151 | proteolipid protein 2 (colonic epithelium-enriched) | 8.68 | up | 0. |
| AA620881 | 1510 | trinucleotide repeat containing 3 | 8.66 | up | 0.00735 |
| AA435665 | 1040 | EST | 8.66 | up | 0.00001 |
| AA451877 | 1138 | EST | 8.63 | up | 0.00489 |
| U79725 | 3437 | glycoprotein A33 (transmembrane) | 8.57 | up | 0.00299 |
| AA043959 | 101 | tropomyosin 4 | 8.54 | up | 0.02222 |
| 080946 | 1737 | SERS protein kinase 1 | 8.53 | up | 0.00455 |
| L21954 | 2177 | benzodiazapine receptor (peripheral) | 8.53 | up | 0.00001 |
| X54667 | 3728 | cystatin S,cystatin SN | 8.53 | up | 0.00059 |
| U47025 | 3367 | phosphorylase, glycogen; brain | 8.52 | up | 0.00134 |
| N62126 | 2588 | EST | 8.51 | up | 0.00016 |
| N73808 | 2678 | EST | 8.46 | up | 0.01886 |
| HG371-HT26388 | | mucin 1, transmembrane | 8.44 | up | 0.00268 |
| T30193 | 3097 | protease, serine, 8 (prostasin) | 8.39 | up | 0.00043 |
| M32886 | 2335 | sorcin | 8.35 | up | 0.00215 |
| U73379 | 3417 | ubiquitin carrier protein E2-C | 8.32 | up | 0.00101 |
| AA429472 | 997 | DKFZP434P106 protein | 8.27 | up | 0.00208 |
| AA406542 | 878 | EST | 8.27 | up | 0.00724 |
| F04674 | 1793 | K1AA0746 protein | 8.2 | up | 0.00028 |
| M27830 | 2314 | EST | 8.2 | up | 0.00294 |
| T03438 | 3042 | EST | 8.18 | up | 0.00032 |
| R56095 | 2905 | EST | 8.16 | up | 0.00023 |
| AA461187 | 1236 | EST | 8.15 | up | 0.00068 |
| 578187 | 3035 | cell division cycle 25B | 8.07 | up | 0.00009 |
| T33489 | 3104 | EST | 8.04 | up | 0.00469 |
| R02036 | 2753 | EST | 8.01 | up | 0.01012 |
| AA295819 | 722 | EST | 8 | up | 0.01793 |
| AA282247 | 657 | EST | 8 | up | 0.00014 |
| U09117 | 3293 | phospholipase C, delta 1 | 7.96 | up | 0.00001 |
| AA479797 | 1316 | EST | 7.93 | up | 0.00006 |
| J04469 | 2111 | creatine kinase, mitochondrial 1 (ubiquitous) | 7.9 | up | 0.00705 |
| Z39429 | 3903 | EST | 7.84 | up | 0.00045 |
| AA053033 | 124 | EST | 7.83 | up | 0.00379 |
| Z40945 | 3924 | trinucleotide repeat containing 15 | 7.82 | up | 0.00007 |
| R45994 | 2866 | EST | 7.81 | up | 0.0018 |
| F04531 | 1791 | Kell blood group precursor (McLeod phenotype) | 7.79 | up | 0.03205 |
| AA425852 | 958 | EST | 7.78 | up | 0.00239 |
| R48447 | 2870 | EST | 7.75 | up | 0.00049 |
| AA243133 | 525 | serine/threonine kinase 15 | 7.73 | up | 0.04328 |
| AA074514 | 160 | EST | 7.69 | up | 0 |
| AA292788 | 714 | EST | 7.69 | up | 0.00967 |
| AA433930 | 1032 | chondroitin 4-sulfotransferase | 7.68 | up | 0.02445 |
| Z23090 | 3865 | heat shock 27kD protein 1 | 7.67 | up | 0.00008 |
| AA196790 | 421 | EST | 7.64 | up | 0.00287 |
| F13809 | 1828 | tropomyosin 1 (alpha) | 7.62 | up | 0.00012 |
| U21049 | 3324 | epithelial protein up-regulated in carcinoma, membrane associated protein 17 | 7.53 | up | 0.01667 |
| K03460 | 2129 | tubulin, alpha 1 (testis specific) | 7.5 | up | 0.00002 |
| D13639 | 1607 | cyclin D2 | 7.49 | up | 0.01641 |
| M31303 | 2327 | leukemia-associated phosphoprotein p18 (stathmin) | 7.48 | up | 0.00021 |
| N69263 | 2647 | EST | 7.47 | up | 0.00004 |
| AF001294 | 1544 | tumor suppressing subtransferable candidate 3 | 7.45 | up | 0.00009 |
| U01062 | 3272 | inositol 1,4,5-triphosphate receptor, type 3 | 7.41 | up | 0 |
| AA463725 | 1249 | mannosyl (alpha-1,6-)-glycoprotein beta-1,2-N-acetylglucosaminyltransferas | 7.4 | up | 0.04715 |
| AA403159 | 845 | Ste-20 related kinase | 7.33 | up | 0.00187 |
| M86752 | 2411 | stress-induced-phosphoprotein 1 (Hsp70/Hsp90-organizing protein) | 7.32 | up | 0.00001 |
| W38044 | | myeloid/lymphoid or mixed-lineage leukemia (trithorax (Drosophila) homolog); translocated to, 7 | 7.28 | up | 0.00105 |
| X04347 | 3677 | heterogeneous nuclear ribonucleoprotein A1 | 7.26 | up | 0.00018 |
| AA452724 | 1149 | programmed cell death 5 | 7.2 | up | 0.00908 |
| AA151428 | 335 | matrix metalloproteinase 23B | 7.15 | up | 0.00056 |
| R38239 | 2829 | EST | 7.14 | up | 0.00249 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| AA292765 | 712 | ZW10 interactor | 7.14 | up | 0.02623 |
| AA204927 | 425 | tropomyosin 1 (alpha) | 7.09 | up | 0.00074 |
| D80710 | 1734 | integral type I protein | 7.08 | up | 0.00213 |
| AB006781 | 1540 | lectin, galactoside-binding, soluble, 4 (galectin 4) | 7.05 | up | 0.00913 |
| S54005 | 3019 | thymosin, beta 10 | 7.03 | up | 0.00334 |
| AA053248 | 126 | EST | 7.01 | up | 0.00003 |
| AA610053 | 1496 | EST | 7.01 | up | 0.00003 |
| N71781 | 2665 | EST | 7.01 | up | 0.02952 |
| M14199 | 2258 | laminin receptor 1 (67kD, ribosomal protein SA) | 7.01 | up | 0 |
| M55998 | 2356 | collagen, type I, alpha 1 | 6.99 | up | 0.00103 |
| T32108 | 3102 | EST | 6.96 | up | 0.00723 |
| AA479044 | 1307 | EST | 6.9 | up | 0.04668 |
| AA449073 | 1117 | EST | 6.89 | up | 0.01445 |
| N22107 | 2448 | EST | 6.88 | up | 0.04259 |
| AA055811 | 133 | glycoprotein A33 (transmembrane) | 6.86 | up | 0.02152 |
| AA226932 | 453 | DKFZP564F0923 protein | 6.84 | up | 0.00405 |
| AA131584 | 268 | DKFZP564O0463 protein | 6.83 | up | 0.00025 |
| R56880 | 2908 | EST | 6.82 | up | 0.02559 |
| AA227926 | 460 | EST | 6.81 | up | 0.01701 |
| U42408 | 3360 | ladinin 1 | 6.8 | up | 0.00305 |
| F01444 | 1770 | KIAA0440 protein | 6.78 | up | 0.00028 |
| AA419217 | 923 | DKFZP586E1422 protein | 6.77 | up | 0.00045 |
| W92207 | 3648 | EST | 6.77 | up | 0.00002 |
| Z41740 | 3932 | EST | 6.76 | up | 0.00049 |
| AA411813 | 893 | postmeiotic segregation increased 2-like 11 | 6.76 | up | 0.03499 |
| AA053007 | 123 | putative receptor protein | 6.76 | up | 0.00061 |
| AA599522 | 1452 | squamous cell carcinoma antigen recognised by T cells | 6.75 | up | 0.04229 |
| L11669 | 2157 | tetracycline transporter-like protein | 6.75 | up | 0.00101 |
| H78211 | 2001 | EST | 6.73 | up | 0.02488 |
| W81540 | 3611 | serine/threonine kinase 24 (Ste20, yeast homolog) | 6.72 | up | 0.00164 |
| R69700 | 2942 | EST | 6.71 | up | 0.0021 |
| AA406145 | 870 | EST | 6.71 | up | 0.00047 |
| X79882 | 3802 | lung resistance-related protein | 6.71 | up | 0.0362 |
| N73762 | 2677 | EST | 6.65 | up | 0.0023 |
| AA429825 | 1003 | DKFZP566B023 protein | 6.63 | up | 0.00032 |
| D55716 | 1686 | minichromosome maintenance deficient (*S. cerevisiae*) 7 | 6.6 | up | 0.00151 |
| AA127712 | 255 | EST | 6.59 | up | 0.03706 |
| W80730 | 3604 | EST | 6.59 | up | 0.00425 |
| Z38266 | 3883 | EST | 6.58 | up | 0.01909 |
| D83783 | 1748 | trinucleotide repeat containing 11 (THR-associated protein, 230 kDa subunit) | 6.55 | up | 0.00176 |
| Z28407 | 3873 | ribosomal protein L8 | 6.53 | up | 0.00004 |
| AA078862 | 173 | EST | 6.52 | up | 0.00025 |
| AA609614 | 1487 | EST | 6.5 | up | 0.00406 |
| HG2797-HT2906 | | clathrin, light polypeptide (Lcb) | 6.5 | up | 0.00013 |
| X64364 | 3761 | basigin | 6.45 | up | 0.00041 |
| AA179787 | 380 | polyglutamine binding protein 1 | 6.44 | up | 0.00206 |
| R61297 | 2919 | eukaryotic translation initiation factor 3, subunit 6 (48kD) | 6.42 | up | 0.00126 |
| C13992 | 1564 | EST | 6.39 | up | 0.00059 |
| AA148885 | 320 | minichromosome maintenance deficient (*S. cerevisiae*) 4 | 6.39 | up | 0.0125 |
| D28124 | 1636 | neuroblastoma candidate region, suppression of tumorigenicity 1 | 6.38 | up | 0.00015 |
| L19605 | 2170 | annexin A11 | 6.38 | up | 0.00017 |
| AB002533 | 1539 | karyopherin alpha 4 (importin alpha 3) | 6.38 | up | 0.00003 |
| R70801 | 2949 | EST | 6.36 | up | 0.00563 |
| N47956 | 2523 | eukaryotic translation initiation factor 3, subunit 3 (gamma, 40kD) | 6.34 | up | 0.00251 |
| L41351 | 2214 | protease, serine, 8 (prostasin) | 6.34 | up | 0.01132 |
| D63486 | 1712 | KIAA0152 gene product | 6.33 | up | 0.00078 |
| HG1153-HT1153 | | non-metastatic cells 2, protein (NM23B) expressed in | 6.31 | up | 0 |
| AA410469 | 883 | EST | 6.3 | up | 0.00103 |
| AA424881 | 949 | EST | 6.3 | up | 0.00556 |
| AA449456 | 1126 | EST | 6.29 | up | 0.00087 |
| AA430048 | 1012 | KIAAOI6O protein | 6.27 | up | 0.00631 |
| X99133 | 3839 | lipocalin 2 (oncogene 24p3) | 6.27 | up | 0.0453 |
| R79580 | 2969 | EST | 6.25 | up | 0.00593 |
| AA028132 | 62 | EST | 6.25 | up | 0.00646 |
| N66624 | 2617 | homolog of mouse quaking QKI (KH domain RNA binding protein) | 6.25 | up | 0 |
| AA010065 | 22 | CDC28 protein kinase 2 | 6.25 | up | 0.02752 |
| M27830 | 2314 | EST | 6.25 | up | 0.00046 |
| W90146 | 3641 | EST | 6.23 | up | 0.01558 |
| AA062721 | 146 | nuclear factor (erythroid-derived 2)-like 1 | 6.2 | up | 0.00024 |
| R96924 | 3000 | EST | 6.18 | up | 0.03417 |
| L23808 | 2179 | matrix metalloproteinase 12 (macrophage elastase) | 6.18 | up | 0.02195 |
| AA053248 | 126 | EST | 6.16 | up | 0.00191 |
| AA453783 | 1158 | EST | 6.16 | up | 0.00167 |
| AA478300 | 1298 | CD39-like 2 | 6.15 | up | 0.01625 |
| N26186 | 2467 | EST | 6.15 | up | 0.00135 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| AA425279 | 951 | quiescin Q6 | 6.15 | up | 0.00083 |
| AA441911 | 1066 | EST | 6.14 | up | 0.00003 |
| U93205 | 3460 | chloride intracellular channel 1 | 6.14 | up | 0.00058 |
| W67251 | 3567 | EST | 6.13 | up | 0.01463 |
| D87953 | 1765 | N-myc downstream regulated | 6.12 | up | 0.00033 |
| U20758 | 3322 | secreted phosphoprotein 1 (osteopontin, bone sialoprotein I, early T-lymphocyte activation 1) | 6.12 | up | 0.03448 |
| M62895 | 2375 | annexin A2,annexin A2 pseudogene 2 | 6.11 | up | 0.00013 |
| AA128561 | 261 | collagen, type XVII, alpha 1 | 6.09 | up | 0.0433 |
| U58682 | 3395 | ribosomal protein S28 | 6.09 | up | 0.00001 |
| AA479727 | 1315 | EST | 6.06 | up | 0.00389 |
| N80703 | 2703 | EST | 6.06 | up | 0.00003 |
| AA279177 | 624 | lymphocyte antigen 75 | 6.05 | up | 0.01821 |
| AA292379 | 708 | EST | 6.04 | up | 0.00568 |
| W74233 | 3594 | related RAS viral (r-ras) oncogene homolog | 6.02 | up | 0.01815 |
| AA007160 | 16 | EST | 6 | up | 0.01035 |
| H09281 | 1863 | EST | 6 | up | 0.00966 |
| Z41798 | 3934 | EST | 6 | up | 0.00073 |
| R97759 | 3005 | serum/glucocorticoid regulated kinase | 5.99 | up | 0.00221 |
| AA284945 | 680 | EST | 5.98 | up | 0.00026 |
| W49574 | 3535 | EST | 5.97 | up | 0.00045 |
| T32072 | 3101 | EST | 5.95 | up | 0.00029 |
| D82558 | 1746 | novel centrosomal protein RanBPM | 5.94 | up | 0.00752 |
| AA463234 | 1246 | KIAA0792 gene product | 5.94 | up | 0.01182 |
| U48705 | 3369 | discoidin domain receptor family, member 1 | 5.94 | up | 0.01323 |
| R52161 | 2892 | EST | 5.84 | up | 0.03253 |
| R76782 | 2962 | O-linked N-acetylglucosamine (GlcNAc) transferase (UDP-N-acetylglucosamine:polypeptide-N-acetylglucosaminyl transferase) | 5.83 | up | 0.01126 |
| R40254 | 2839 | EST | 5.82 | up | 0.00304 |
| H81413 | 2007 | high-mobility group (nonhistone chromosomal) protein isoforms I andY | 5.82 | up | 0.00769 |
| H75933 | 1998 | laminin receptor 1 (67kD, ribosomal protein SA) | 5.81 | up | 0.00024 |
| T15473 | 3057 | muscle specific gene | 5.81 | up | 0.02404 |
| M27830 | 2314 | EST | 5.78 | up | 0.0017 |
| AA478017 | 1295 | zyxin | 5.77 | up | 0.00484 |
| AA179845 | 381 | EST | 5.77 | up | 0.01414 |
| AA151778 | 338 | claudin 7 | 5.77 | up | 0.00002 |
| U78556 | 3432 | cisplatin resistance associated | 5.77 | up | 0.00241 |
| U51478 | 3384 | ATPase, Na+/K+ transporting, beta 3 polypeptide | 5.75 | up | 0.00007 |
| U73843 | 3420 | E74-like factor 3 (ets domain transcription factor) | 5.75 | up | 0.00017 |
| AA236037 | 506 | EST | 5.74 | up | 0.0091 |
| M60784 | 2366 | small nuclear ribonucleoprotein polypeptide A | 5.74 | up | 0.00126 |
| R44538 | 2855 | EST | 5.73 | up | 0.01015 |
| AA287393 | 688 | EST | 5.68 | up | 0.00062 |
| D26129 | 1635 | ribonuclease, RNase A family, 1 (pancreatic) | 5.68 | up | 0.03827 |
| L76191 | 2222 | interleukin-1 receptor-associated kinase 1 | 5.66 | up | 0.00089 |
| N52168 | 2550 | EST | 5.65 | up | 0.00003 |
| D51393 | 1681 | ribosomal protein L4 | 5.64 | up | 0.00074 |
| T47325 | 3124 | EST | 5.63 | up | 0.01015 |
| M10098 | 2231 | EST | 5.62 | up | 0.00251 |
| M86400 | 2409 | tyrosine 3-monooxygenase/tryptophan 5-monooxygenase activation protein, zeta polypeptide | 5.62 | up | 0.00016 |
| M10098 | 2231 | EST | 5.61 | up | 0.01238 |
| D11086 | 1595 | interleukin 2 receptor, gamma (severe combined immunodeficiency) | 5.61 | up | 0.00873 |
| AA093497 | 199 | DEK oncogene (DNA binding) | 5.6 | up | 0.02551 |
| AA452536 | 1145 | v-ral simian leukemia viral oncogene homolog A (ras related) | 5.6 | up | 0.00481 |
| AA279840 | 632 | titin-cap (telethonin) | 5.58 | up | 0.01253 |
| N71072 | 2663 | EST | 5.57 | up | 0.03881 |
| R06251 | 2763 | tumor protein D52-like 2 | 5.57 | up | 0.00037 |
| N66951 | 2620 | EST | 5.54 | up | 0.02442 |
| AA188378 | 392 | EST | 5.54 | up | 0.01359 |
| U46692 | 3366 | cystatin B (stefin B) | 5.54 | up | 0.00016 |
| U20499 | 3320 | sulfotransferase family 1A, phenol-preferring, member 3 | 5.5 | up | 0.00299 |
| AA287347 | 687 | EST | 5.47 | up | 0.00034 |
| M81757 | 2405 | ribosomal protein S19 | 5.46 | up | 0 |
| S81914 | 3037 | immediate early response 3 | 5.46 | up | 0.01798 |
| AA262887 | 610 | EST | 5.4 | up | 0.04719 |
| D63487 | 1713 | KIAA0153 protein | 5.4 | up | 0.00027 |
| J05582 | 2121 | mucin 1, transmembrane | 5.39 | up | 0.00056 |
| T23516 | 3082 | 3-phosphoglycerate dehydrogenase | 5.38 | up | 0.00001 |
| AA181600 | 384 | EST | 5.38 | up | 0.03316 |
| H99473 | 2077 | regulator of nonsense transcripts 1 | 5.37 | up | 0.00177 |
| AA459254 | 1211 | EST | 5.36 | up | 0.0259 |
| C14756 | 1570 | MLN51 protein | 5.36 | up | 0.00001 |
| M10098 | 2231 | EST | 5.35 | up | 0.00186 |
| AA485405 | 1343 | EST | 5.35 | up | 0.03475 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| N69252 | 2646 | ferritin, light polypeptide | 5.33 | up | 0.01554 |
| HG1612-HT1612 | | MARCKS-like protein | 5.32 | up | 0.00007 |
| M20471 | 2289 | clathrin, light polypeptide (Lca) | 5.32 | up | 0.00344 |
| AA126719 | 250 | EST | 5.31 | up | 0.00026 |
| T16308 | 3068 | EST | 5.29 | up | 0.00119 |
| AA335091 | 740 | EST | 5.28 | up | 0.0009 |
| AA189015 | 394 | EST | 5.27 | up | 0.00004 |
| AA450247 | 1133 | EST | 5.27 | up | 0.02833 |
| HG1614-HT1614 | | protein phosphatase 1, catalytic subunit, alpha isoform | 5.27 | up | 0.00257 |
| L19686 | 2171 | macrophage migration inhibitory factor (glycosylation-inhibiting factor) | 5.26 | up | 0.00562 |
| J04152 | 2107 | membrane component, chromosome 1, surface marker I (40kD glycoprotein, identified by monoclonal antibody GA733) | 5.26 | up | 0.02466 |
| U14972 | 3306 | ribosomal protein S10 | 5.24 | up | 0.00077 |
| AA459388 | 1215 | copine I | 5.23 | up | 0.00691 |
| T16983 | 3073 | cleavage and polyadenylation specific factor 4, 30kD subunit | 5.23 | up | 0.00075 |
| C15324 | 1574 | EST | 5.22 | up | 0.00344 |
| L04490 | 2137 | NADH dehydrogenase (ubiquinone) 1 alpha subcomplex, 9 (39kD) | 5.22 | up | 0.02192 |
| AA291137 | 694 | EST | 5.21 | up | 0.00685 |
| R38511 | 2831 | protein similar to *E. coli* yhdg and R. capsulatus nifR3 | 5.19 | up | 0.00015 |
| R06866 | 2773 | EST | 5.18 | up | 0.00187 |
| D20906 | 1627 | EST | 5.18 | up | 0.02189 |
| H05625 | 1847 | EST | 5.17 | up | 0.04551 |
| AA011383 | 31 | EST | 5.17 | up | 0.00008 |
| N20198 | 2439 | ubiquitin-conjugating enzyme E2 variant 1 | 5.17 | up | 0.00508 |
| AA490494 | 1377 | EST | 5.16 | up | 0.01696 |
| S69272 | 3027 | protease inhibitor 6 (placental thrombin inhibitor) | 5.15 | up | 0.00003 |
| AA471278 | 1277 | BUB3 (budding uninhibited by benzimidazoles 3, yeast) homolog | 5.14 | up | 0.00873 |
| AA026150 | 55 | EST | 5.14 | up | 0.01072 |
| AA086232 | 186 | kangai 1 (suppression of tumorigenicity 6, prostate; CD82 antigen (R2 leukocyte antigen, antigen detected by monoclonal and antibody IA4)) | 5.14 | up | 0.01916 |
| AA620466 | 1502 | EST | 5.14 | up | 0.00004 |
| X17206 | 3715 | ribosomal protein S2 | 5.14 | up | 0 |
| J04423 | 2109 | EST | 5.13 | up | 0.02791 |
| W92608 | 3650 | BAI1-associated protein 3 | 5.12 | up | 0.00075 |
| AA434418 | 1036 | KIAA1115 protein | 5.12 | up | 0.00498 |
| AA482319 | 1335 | putative type II membrane protein | 5.11 | up | 0.00177 |
| AA249819 | 535 | EST | 5.09 | up | 0.00136 |
| AA442763 | 1072 | cyclin B2 | 5.09 | up | 0.02168 |
| T26513 | 3094 | protein phosphatase 2 (formerly 2A), regulatory subunit A (PR 65), alpha isoform | 5.07 | up | 0.0016 |
| H09271 | 1862 | EST | 5.06 | up | 0.0016 |
| H88674 | 2021 | collagen, type I, alpha 2 | 5.06 | up | 0.00866 |
| X98482 | 3838 | EST | 5.03 | up | 0.00002 |
| H43286 | 1929 | gamma-aminobutyric acid (GABA) B receptor, 1 | 5.02 | up | 0.01972 |
| AA364267 | 762 | EST | 5.01 | up | 0.00255 |
| AA464963 | 1265 | EST | 5.01 | up | 0.00107 |
| AA147439 | 315 | EST | 5.01 | up | 0.00336 |
| T15442 | 3056 | calpain, large polypeptide L1 | 5.01 | up | 0.00255 |
| N77947 | 2697 | EST | 5 | up | 0.00117 |
| L06505 | 2142 | ribosomal protein L12 | 5 | up | 0.00163 |
| AA280283 | 637 | EST | 4.99 | up | 0.02644 |
| AA447991 | 1112 | EST | 4.99 | up | 0.00173 |
| AA464414 | 1258 | EST | 4.99 | up | 0.00529 |
| AA075580 | 165 | EST | 4.98 | up | 0.02083 |
| U17077 | 3313 | BENE protein | 4.98 | up | 0.00366 |
| AA476216 | 1279 | EST | 4.97 | up | 0.00359 |
| AA132554 | 273 | EST | 4.96 | up | 0.02076 |
| AA504270 | 1411 | EST | 4.96 | up | 0.01919 |
| R48589 | 2873 | EST | 4.95 | up | 0.01346 |
| R58974 | 2909 | EST | 4.95 | up | 0.00498 |
| AA283085 | 667 | EST | 4.93 | up | 0.00382 |
| AA489712 | 1372 | EST | 4.93 | up | 0.00726 |
| AA496981 | 1404 | v-erb-b2 avian erythroblastic leukemia viral oncogene homolog 3 | 4.93 | up | 0.01096 |
| D14520 | 1613 | basic transcription element binding protein 2 | 4.93 | up | 0.00004 |
| AA402495 | 838 | EST | 4.91 | up | 0.00235 |
| U15008 | 3308 | small nuclear ribonucleoprotein D2 polypeptide (16.5kD) | 4.9 | up | 0.00396 |
| AA406218 | 872 | EST | 4.88 | up | 0.02194 |
| AA482127 | 1333 | protein kinase related to *S. cerevisiae* STE20, effector for Cdc42Hs | 4.88 | up | 0.00017 |
| M79463 | 2401 | promyelocytic leukemia | 4.88 | up | 0.01821 |
| AA146619 | 312 | EST | 4.87 | up | 0.00863 |
| AA262477 | 608 | ribonuclease HI, large subunit | 4.87 | up | 0.00005 |
| AA121315 | 237 | KIAA1077 protein | 4.86 | up | 0.02438 |
| H38568 | 1918 | EST | 4.86 | up | 0.0003 |
| AA306121 | 729 | EST | 4.85 | up | 0.00381 |
| D51133 | 1676 | tubulin, beta, 4 | 4.84 | up | 0.02875 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| W02041 | 3465 | EST | 4.83 | up | 0.00158 |
| T55004 | 3145 | EST | 4.83 | up | 0.00156 |
| Z74616 | 3947 | collagen, type I, alpha 2 | 4.83 | up | 0.02364 |
| X17093 | 3713 | EST | 4.82 | up | 0.00176 |
| D51276 | 1678 | leukemia-associated phosphoprotein p18 (stathmin) | 4.81 | up | 0.00514 |
| M77349 | 2399 | transforming growth factor, beta-induced, 68kD | 4.81 | up | 0.00546 |
| AA425852 | 958 | EST | 4.8 | up | 0.03874 |
| R22565 | 2799 | EST | 4.8 | up | 0.0424 |
| M10098 | 2231 | EST | 4.79 | up | 0.00328 |
| D13413 | 1604 | heterogeneous nuclear ribonucleoprotein U (scaffold attachment factor A) | 4.79 | up | 0.00092 |
| H46486 | 1932 | nesca protein | 4.77 | up | 0.00421 |
| U51095 | 3381 | caudal type homeo box transcription factor 1 | 4.76 | up | 0.02664 |
| AA609786 | 1491 | nucleolar protein 1 (l20kD) | 4.75 | up | 0.00261 |
| AA251230 | 540 | EST | 4.75 | up | 0.00054 |
| AA459703 | 1222 | v-myc avian myelocytomatosis viral oncogene homolog | 4.75 | up | 0.02413 |
| AA131084 | 265 | procollagen-lysine, 2-oxoglutarate 5-dioxygenase 3 | 4.74 | up | 0.00427 |
| D50914 | 1673 | KIAA0124 protein | 4.74 | up | 0.00752 |
| T35341 | 3111 | EST | 4.73 | up | 0.00057 |
| AA253011 | 558 | KIAA0713 protein | 4.73 | up | 0.01944 |
| X74929 | 3789 | keratin 8 | 4.73 | up | 0.00018 |
| D25560 | 1634 | EST | 4.72 | up | 0.00661 |
| X62535 | 3753 | diacylglycerol kinase, alpha (80kD) | 4.72 | up | 0.00315 |
| X66899 | 3769 | Ewing sarcoma breakpoint region 1 | 4.72 | up | 0.00011 |
| X68688 | 3777 | zinc finger protein 33a (KOX 31) | 4.7 | up | 0.00062 |
| AB000584 | 1533 | prostate differentiation factor | 4.7 | up | 0.00071 |
| AA293719 | 720 | EST | 4.69 | up | 0.02181 |
| R39191 | 2833 | KIAA1020 protein | 4.69 | up | 0.00456 |
| AA598405 | 1424 | membrane interacting protein of RGS16 | 4.69 | up | 0.0122 |
| U12465 | 3299 | ribosomal protein L35 | 4.69 | up | 0.00001 |
| AA405715 | 862 | hypothetical protein | 4.68 | up | 0.00898 |
| AA131162 | 266 | EST | 4.68 | up | 0.00042 |
| U78525 | 3431 | eukaryotic translation initiation factor 3, subunit 9 (eta, 116kD) | 4.68 | up | 0.00132 |
| AA171939 | 368 | EST | 4.67 | up | 0.00104 |
| M10098 | 2231 | EST | 4.66 | up | 0.00405 |
| AA298786 | 727 | EST | 4.65 | up | 0.02821 |
| N93798 | 2737 | protein tyrosine phosphatase type IVA, member 3 | 4.65 | up | 0.00118 |
| R06254 | 2764 | tumor protein D52-like 2 | 4.64 | up | 0.00039 |
| L20591 | 2173 | annexin A3 | 4.64 | up | 0.00065 |
| U14969 | 3303 | ribosomal protein L28 | 4.63 | up | 0.00004 |
| AA482224 | 1334 | putative type II membrane protein | 4.62 | up | 0.0105 |
| T26471 | 3093 | EST | 4.62 | up | 0.01091 |
| R70005 | 2943 | EST | 4.61 | up | 0.00037 |
| HG3548-HT3749 | | cut (Drosophila)-like 1 (CCAAT displacement protein) | 4.61 | up | 0.00824 |
| H43646 | 1930 | H2A histone family, member Y | 4.6 | up | 0.00147 |
| AA455521 | 1178 | E2F transcription factor 5, p130-binding | 4.6 | up | 0.00773 |
| H05525 | 1846 | hypothetical protein | 4.6 | up | 0.0033 |
| S56151 | 3020 | milk fat globule-EGF factor 8 protein | 4.59 | up | 0.0091 |
| AA143493 | 310 | pleckstrin 2 (mouse) homolog | 4.58 | up | 0.01037 |
| F04444 | 1788 | EST | 4.57 | up | 0.01132 |
| AA412301 | 899 | EST | 4.57 | up | 0.00026 |
| D31417 | 1645 | secreted protein of unknown function | 4.56 | up | 0.00014 |
| AA025277 | 51 | EST | 4.56 | up | 0.03136 |
| AA478415 | 1299 | EST | 4.56 | up | 0.00095 |
| HG3364-HT3541 | | ribosomal protein L37 | 4.55 | up | 0.00005 |
| M24194 | 2302 | guanine nucleotide binding protein (G protein), beta polypeptide 2-like 1 | 4.55 | up | 0.00017 |
| AA261907 | 603 | DKFZP566E144 protein | 4.54 | up | 0.02289 |
| U04313 | 3283 | protease inhibitor 5 (maspin) | 4.54 | up | 0.02986 |
| AA287022 | 685 | thymidine kinase 1, soluble | 4.51 | up | 0.02582 |
| M34182 | 2340 | protein kinase, cAMP-dependent, catalytic, gamma | 4.51 | up | 0.00043 |
| D38548 | 1655 | KIAA0076 gene product | 4.5 | up | 0.00036 |
| X69150 | 3779 | ribosomal protein S18 | 4.5 | up | 0.00003 |
| AA262969 | 613 | ferritin, heavy polypeptide 1 | 4.49 | up | 0.00013 |
| M22960 | 2296 | protective protein for beta-galactosidase (galactosialidosis) | 4.49 | up | 0.00898 |
| AA094752 | 203 | hypothetical 43.2 Kd protein | 4.47 | up | 0.00243 |
| J04423 | 2109 | EST | 4.47 | up | 0.02754 |
| T98284 | 3267 | EST | 4.47 | up | 0.00054 |
| HG2873-HT3017 | | ribosomal protein L30 | 4.47 | up | 0.00009 |
| Z24727 | 3868 | tropomyosin 1 (alpha) | 4.47 | up | 0.00121 |
| U75285 | 3421 | apoptosis inhibitor 4 (survivin) | 4.46 | up | 0.02212 |
| M14483 | 2261 | prothymosin, alpha (gene sequence 28) | 4.46 | up | 0.00686 |
| J03827 | 2100 | nuclease sensitive element binding protein 1 | 4.45 | up | 0.00015 |
| X15940 | 3706 | ribosomal protein L31 | 4.45 | up | 0.00004 |
| N31597 | 2486 | DKFZP564G2022 protein | 4.44 | up | 0.00085 |
| N21359 | 2441 | EST | 4.43 | up | 0.00078 |
| Z26876 | 3871 | ribosomal protein L38 | 4.43 | up | 0.00022 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| N39099 | 2507 | EST | 4.42 | up | 0.00643 |
| N39254 | 2511 | EST | 4.42 | up | 0.00478 |
| T77733 | 3218 | tubulin, gamma 1 | 4.42 | up | 0.00049 |
| D31094 | 1639 | G8 protein | 4.41 | up | 0.04845 |
| AA482546 | 1336 | KIAA0124 protein | 4.41 | up | 0.00604 |
| N70903 | 2661 | EST | 4.41 | up | 0.0078 |
| AA070827 | 157 | EST | 4.41 | up | 0.01902 |
| Z25749 | 3869 | nuclear factor of kappa light polypeptide gene enhancer in B-cells inhibitor-like 2 | 4.41 | up | 0.00031 |
| N68921 | 2638 | EST | 4.4 | up | 0.00989 |
| T23465 | 3080 | EST | 4.4 | up | 0.017 |
| AA147084 | 314 | proliferation-associated 2G4, 38kD | 4.4 | up | 0.0045 |
| W52858 | 3542 | DKFZPS64F0522 protein | 4.38 | up | 0.00088 |
| R49395 | 2880 | EST | 4.38 | up | 0.00112 |
| D53139 | 1684 | ribosomal protein S28 | 4.38 | up | 0.0009 |
| H18412 | 1890 | isocitrate dehydrogenase 3 (NAD+) gamma | 4.37 | up | 0.00262 |
| U25789 | 3333 | ribosomal protein L21 | 4.37 | up | 0.00045 |
| J04423 | 2109 | EST | 4.35 | up | 0.01245 |
| AA236714 | 516 | nuclear mitotic apparatus protein 1 | 4.35 | up | 0.00083 |
| U90913 | 3458 | Tax interaction protein 1 | 4.35 | up | 0.00159 |
| L44538 | 2217 | EST | 4.34 | up | 0.04319 |
| L06499 | 2141 | ribosomal protein L37a | 4.34 | up | 0.01103 |
| M17886 | 2282 | ribosomal protein, large, P1 | 4.34 | up | 0.00044 |
| AA320369 | 735 | chromosome 19 open reading frame 3 | 4.33 | up | 0.00554 |
| AA598988 | 1442 | EST | 4.32 | up | 0.00044 |
| R26744 | 2803 | midline 1 (Opitz/BBB syndrome) | 4.32 | up | 0.00532 |
| W44557 | 3515 | chromosome 1 open reading frame 2 | 4.32 | up | 0.00128 |
| AA173430 | 371 | EST | 4.32 | up | 0.04362 |
| L34587 | 2200 | transcription elongation factor B (SIII), polypeptide 1 (15kD, elongin C) | 4.32 | up | 0.00287 |
| X06617 | 3684 | ribosomal protein S11 | 4.32 | up | 0.0002 |
| W93943 | 3654 | EST | 4.3 | up | 0.00296 |
| AA608579 | 1464 | paired-like homeodomain transcription factor 2 | 4.29 | up | 0.04435 |
| W60486 | 3555 | EST | 4.29 | up | 0.00964 |
| L11566 | 2156 | ribosomal protein L18 | 4.29 | up | 0.00014 |
| HG1980-HT2023 | | tubulin, beta polypeptide | 4.29 | up | 0.00408 |
| AA122386 | 239 | collagen, type V, alpha 2 | 4.28 | up | 0.005 |
| H38240 | 1916 | thrombospondin 2 | 4.28 | up | 0.0066 |
| X64707 | 3762 | ribosomal protein L13 | 4.28 | up | 0.00257 |
| Y10807 | 3857 | HMT1 (hnRNP methyltransferase, *S. cerevisiae*)-like 2 | 4.28 | up | 0.00124 |
| AA070206 | 155 | EST | 4.26 | up | 0.00018 |
| N89670 | 2708 | EST | 4.26 | up | 0.00002 |
| D63880 | 1715 | KIAA0159 gene product | 4.26 | up | 0.00253 |
| AA431719 | 1025 | EST | 4.25 | up | 0.00015 |
| Z40583 | 3919 | EST | 4.24 | up | 0.02375 |
| AA426447 | 965 | EST | 4.23 | up | 0.0309 |
| AA453477 | 1153 | X-prolyl aminopeptidase (aminopeptidase P)-Iike | 4.23 | up | 0.0001 |
| AA278817 | 618 | EST | 4.22 | up | 0.00061 |
| HG2239-HT2324 | | potassium voltage-gated channel, Shaw-related subfamily, member 3 | 4.22 | up | 0.0065 |
| AA033790 | 74 | apolipoprotein D | 4.21 | up | 0.03247 |
| N70678 | 2659 | TAR (HIV) RNA-binding protein 1 | 4.2 | up | 0.00119 |
| W45487 | 3521 | dynamin 2 | 4.2 | up | 0.00325 |
| L04483 | 2136 | ribosomal protein S21 | 4.2 | up | 0.00057 |
| AA132032 | 271 | trinucleotide repeat containing 1 | 4.19 | up | 0.00295 |
| AA282149 | 654 | huntingtin interacting protein-1-related | 4.19 | up | 0.00091 |
| R59352 | 2914 | KIAA0296 gene product | 4.19 | up | 0.00393 |
| D88154 | 1766 | villin-like | 4.18 | up | 0.00051 |
| D59322 | 1694 | EST | 4.18 | up | 0.00006 |
| U12404 | 3298 | ribosomal protein L10a | 4.18 | up | 0.00004 |
| S73885 | 3031 | transcription factor AP-4 (activating enhancer-binding protein 4) | 4.18 | up | 0.00005 |
| AA398205 | 789 | EST | 4.17 | up | 0.00004 |
| H09241 | 1861 | EST | 4.17 | up | 0.00727 |
| HG1800-HT1823 | | ribosomal protein S20 | 4.17 | up | 0.00001 |
| H27188 | 1908 | collagen-binding protein 2 (colligen 2) | 4.16 | up | 0.02073 |
| H56345 | 1950 | EST | 4.15 | up | 0.00488 |
| M17733 | 2280 | thymosin, beta 4, X chromosome | 4.15 | up | 0.00009 |
| U78027 | 3428 | EST | 4.15 | up | 0.00295 |
| AA482613 | 1338 | DKFZP434B203 protein | 4.14 | up | 0.00186 |
| F09788 | 1808 | procollagen-proline, 2-oxoglutarate 4-dioxygenase (proline 4-hydroxylase), alpha polypeptide II | 4.14 | up | 0.00003 |
| R44479 | 2854 | KIAA0552 gene product | 4.14 | up | 0.0181 |
| AA075722 | 166 | nuclear transport factor 2 (placental protein 15) | 4.14 | up | 0.00374 |
| U31556 | 3345 | E2F transcription factor 5, p130-binding | 4.14 | up | 0.01157 |
| AA263044 | 615 | H2A histone family, memberY | 4.13 | up | 0.00024 |
| AA256273 | 577 | EST | 4.13 | up | 0.03874 |
| AA443316 | 1075 | v-Ha-ras Harvey rat sarcoma viral oncogene homolog | 4.13 | up | 0.01729 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| X80822 | 3805 | ribosomal protein L18a | 4.13 | up | 0.0006 |
| AA224502 | 451 | EST | 4.12 | up | 0.00694 |
| AA461476 | 1243 | EST | 4.12 | up | 0.00871 |
| R31107 | 2811 | EST | 4.12 | up | 0.00003 |
| R43952 | 2852 | homeo box B5 | 4.11 | up | 0.04316 |
| R36947 | 2824 | calcium channel, voltage-dependent, beta 3 subunit | 4.11 | up | 0.00006 |
| T40849 | 3115 | maternal G10 transcript | 4.11 | up | 0.00449 |
| X14850 | 3703 | H2A histone family, member X | 4.11 | up | 0.0001 |
| AA026356 | 57 | EST | 4.1 | up | 0.00133 |
| D50663 | 1671 | t-complex-associated-testis-expressed 1-like 1 | 4.09 | up | 0.00208 |
| X03342 | 3672 | ribosomal protein L32 | 4.09 | up | 0.00008 |
| X62691 | 3754 | ribosomal protein S15a | 4.09 | up | 0.00005 |
| R38076 | 2827 | EST | 4.08 | up | 0.00374 |
| Z39079 | 3897 | KIAA1058 protein | 4.08 | up | 0.01781 |
| D57489 | 1689 | chaperonin containing TCP1, subunit 7 (eta) | 4.08 | up | 0.00001 |
| N50048 | 2541 | EST | 4.08 | up | 0.00085 |
| M87339 | 2414 | replication factor C (activator 1)4 (37kD) | 4.07 | up | 0.00316 |
| C14348 | 1568 | EST | 4.06 | up | 0.00111 |
| H05394 | 1845 | K1AA0266 gene product | 4.06 | up | 0.0015 |
| H97809 | 2063 | EST | 4.05 | up | 0.00111 |
| T47601 | 3125 | EST | 4.05 | up | 0.00878 |
| U62962 | 3403 | eukaryotic translation initiation factor 3, subunit 6 (48kD) | 4.05 | up | 0.0047 |
| T55196 | 3146 | EST | 4.04 | up | 0.00012 |
| AA431873 | 1028 | EST | 4.03 | up | 0.00785 |
| N66139 | 2614 | neurochondrin | 4.03 | up | 0.00118 |
| HG3214-HT3391 | | ribosomal protein S27 (metallopanstimulin 1) | 4.03 | up | 0.00238 |
| AA405460 | 857 | EST | 4.02 | up | 0.03492 |
| AA236533 | 514 | ecotropic viral integration site 1 | 4.01 | up | 0.02882 |
| T91116 | 3251 | EST | 4.01 | up | 0.02721 |
| AA034378 | 77 | endogenous retroviral protease | 4.01 | up | 0.00974 |
| D49400 | 1667 | ATPase, vacuolar, 14 kD | 4.01 | up | 0.00287 |
| M32405 | 2334 | ribosomal protein S15 | 4.01 | up | 0.00055 |
| U14968 | 3302 | ribosomal protein L27a | 4.01 | up | 0.00003 |
| W31382 | 3494 | EST | 4 | up | 0.00058 |
| D86956 | 1753 | heat shock 105kD | 4 | up | 0.03013 |
| X70040 | 3785 | macrophage stimulating 1 receptor (c-met-related tyrosine kinase) | 4 | up | 0.00402 |
| M13934 | 2255 | ribosomal protein S14 | 3.99 | up | 0 |
| H53657 | 1945 | adenylate cyclase 3 | 3.98 | up | 0.0045 |
| W28362 | 3487 | K1AA0974 protein | 3.98 | up | 0.00626 |
| W20391 | 3478 | kinesin-like 2 | 3.98 | up | 0.01788 |
| AA292931 | 715 | EST | 3.97 | up | 0.00067 |
| H13532 | 1881 | ribosomal protein L18a | 3.97 | up | 0.00061 |
| T66935 | 3178 | EST | 3.97 | up | 0.00188 |
| L03411 | 2134 | RD RNA-binding protein | 3.97 | up | 0.00422 |
| AA291456 | 700 | EST | 3.96 | up | 0.03633 |
| AA496245 | 1398 | EST | 3.96 | up | 0.0039 |
| U85773 | 3448 | phosphomannomutase 2 | 3.94 | up | 0.00288 |
| F09297 | 1800 | EST | 3.94 | up | 0.0016 |
| H93492 | 2037 | EST | 3.94 | up | 0.01136 |
| U53830 | 3390 | interferon regulatory factor 7 | 3.94 | up | 0.03147 |
| 82348 | 1744 | 5-aminoimidazole-4-carboxamide ribonucleotide formyltransferase/IMP cyclohydrolase | 3.93 | up | 0.00037 |
| U14971 | 3305 | ribosomal protein S9 | 3.93 | up | 0.00026 |
| X52966 | 3723 | ribosomal protein L35a | 3.93 | up | 0.00217 |
| AF004709 | 1547 | mitogen-activated protein kinase 13 | 3.92 | up | 0.0009 |
| D87735 | 1764 | ribosomal protein L14 | 3.92 | up | 0.00015 |
| M17885 | 2281 | ribosomal protein, large, P0 | 3.92 | up | 0.00003 |
| D63391 | 1710 | platelet-activating factor acetyihydrolase, isoform Ib, gamma subunit (29kD) | 3.91 | up | 0.00062 |
| X77588 | 3796 | N-acetyltransferase, homolog of S. cerevisiae ARD1 | 3.91 | up | 0.0221 |
| M29277 | 2316 | melanoma adhesion molecule | 3.91 | up | 0.00112 |
| C14412 | 1569 | HSPC038 protein | 3.9 | up | 0.00036 |
| AA215468 | 441 | ADP-ribosylation factor-related protein 1 | 3.9 | up | 0.04549 |
| H29565 | 1913 | EST | 3.89 | up | 0.01856 |
| AA234362 | 481 | EST | 3.89 | up | 0.03524 |
| X51521 | 3718 | villin 2 (ezrin) | 3.89 | up | 0.00001 |
| AA253330 | 562 | adaptor-related protein complex 1, gamma 1 subunit | 3.87 | up | 0.00708 |
| AA191708 | 400 | EST | 3.87 | up | 0.01904 |
| N91023 | 2715 | EST | 3.87 | up | 0.00008 |
| N98758 | 2744 | EST | 3.87 | up | 0.0074 |
| L40379 | 2210 | thyroid receptor interacting protein 10 (CDC42-interacting protein) | 3.87 | up | 0.00207 |
| N92775 | 2722 | amyloid beta (A4) precursor protein-binding, family A, member 3 (X11-like 2) | 3.86 | up | 0.00577 |
| AA187938 | 391 | EST | 3.86 | up | 0.00512 |
| Z30643 | 3876 | chloride channel Ka | 3.86 | up | 0.00204 |
| C21248 | 1585 | pituitary tumor-transforming I | 3.85 | up | 0.00456 |
| D86974 | 1756 | K1AA0220 protein | 3.85 | up | 0.0161 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| HG821-HT821 | | ribosomal protein S13 | 3.84 | up | 0.00003 |
| X80909 | 3806 | nascent-polypeptide-associated complex alpha polypeptide | 3.84 | up | 0.00399 |
| W76097 | 3596 | EST | 3.83 | up | 0.00001 |
| AA291659 | 702 | EST | 3.83 | up | 0.01934 |
| W80763 | 3605 | EST | 3.83 | up | 0.01319 |
| AA026092 | 54 | EST | 3.83 | up | 0.04596 |
| AA411685 | 890 | EST | 3.83 | up | 0.00417 |
| Z41103 | 3926 | trinucleotide repeat containing 15 | 3.83 | up | 0.00444 |
| AA455522 | 1179 | EST | 3.83 | up | 0.00017 |
| D21063 | 1628 | minichromosome maintenance deficient (*S. cerevisiae*) 2 (mitotin) | 3.83 | up | 0.00983 |
| D42085 | 1658 | KIAA0095 gene product | 3.83 | up | 0.00036 |
| HG3039-HT3200 | | ADP-ribosylation factor 1 | 3.83 | up | 0.00077 |
| L33075 | 2195 | IQ motif containing GTPase activating protein 1 | 3.83 | up | 0.00015 |
| M77232 | 2398 | ribosomal protein S6 | 3.82 | up | 0.00045 |
| R56678 | 2907 | EST | 3.81 | up | 0.02242 |
| AA621277 | 1520 | EST | 3.81 | up | 0.00194 |
| AA437387 | 1064 | EST | 3.81 | up | 0.01478 |
| N49738 | 2538 | EST | 3.81 | up | 0.02479 |
| AA504264 | 1410 | EST | 3.81 | up | 0.00684 |
| U53347 | 3388 | solute carrier family 1 (neutral amino acid transporter), member 5 | 3.81 | up | 0.00273 |
| X55954 | 3733 | ribosomal protein L23 | 3.81 | up | 0.00025 |
| D54296 | 1685 | KIAA0255 gene product | 3.8 | up | 0.01059 |
| M30496 | 2324 | ubiquitin carboxyl-terminal esterase L3 (ubiquitin thiolesterase) | 3.8 | up | 0.00478 |
| U11861 | 3297 | maternal G10 transcript | 3.8 | up | 0.00001 |
| N27186 | 2469 | EST | 3.79 | up | 0.00112 |
| H49637 | 1940 | EST | 3.79 | up | 0.01092 |
| M18000 | 2283 | ribosomal protein S17 | 3.79 | up | 0.00004 |
| U09564 | 3294 | SFRS protein kinase 1 | 3.79 | up | 0.00765 |
| F09684 | 1805 | EST | 3.78 | up | 0.00277 |
| AA128407 | 259 | EST | 3.78 | up | 0.01081 |
| R28636 | 2808 | UDP-Gal:betaGlcNAc beta 1,4- galactosyltransferase, polypeptide 3 | 3.78 | up | 0.00765 |
| L12350 | 2160 | thrombospondin 2 | 3.78 | up | 0.00061 |
| N93105 | 2727 | EST | 3.77 | up | 0.02195 |
| HG3945-HT4215 | | phospholipid transfer protein | 3.77 | up | 0.03169 |
| AA131894 | 269 | EST | 3.76 | up | 0.00384 |
| T48195 | 3130 | eukaryotic translation initiation factor 3, subunit 3 (gamma, 40kD) | 3.75 | up | 0.00012 |
| N68038 | 2631 | phorbolin (similar to apolipoprotein B mRNA editing protein) | 3.75 | up | 0.01041 |
| AA437368 | 1063 | EST | 3.75 | up | 0.01317 |
| M15205 | 2265 | thymidine kinase 1, soluble | 3.75 | up | 0.00159 |
| AA620995 | 1512 | EST | 3.74 | up | 0.03414 |
| M10098 | 2231 | EST | 3.73 | up | 0.01794 |
| AA113303 | 227 | transmembrane 4 superfamily member (tetraspan NET-7) | 3.73 | up | 0.00084 |
| X69908 | 3783 | ATP synthase, H +transporting, mitochondrial F0 complex, subunit c (subunit 9), isoform 2 | 3.73 | up | 0.00685 |
| AA179298 | 378 | stomatin-like protein 2 | 3.72 | up | 0.00299 |
| M96739 | 2433 | nescient helix loop helix 1 | 3.72 | up | 0.00015 |
| X55715 | 3732 | ribosomal protein S3 | 3.72 | up | 0.00755 |
| AA436027 | 1050 | EST | 3.71 | up | 0.03676 |
| H04799 | 1841 | EST | 3.71 | up | 0.04109 |
| Z40898 | 3922 | EST | 3.71 | up | 0.01168 |
| AA025166 | 50 | fusion, derived from t(12;16) malignant liposarcoma | 3.71 | up | 0.0052 |
| AA150053 | 327 | EST | 3.71 | up | 0.00102 |
| AA490212 | 1375 | H2A histone family, member Y | 3.71 | up | 0.01226 |
| AA307748 | 730 | EST | 3.7 | up | 0.00001 |
| N29888 | 2482 | EST | 3.7 | up | 0.00226 |
| AA034499 | 78 | zinc finger protein 198 | 3.7 | up | 0.02143 |
| D14657 | 1615 | KIAA0101 gene product | 3.7 | up | 0.04079 |
| L38696 | 2208 | RNA-binding protein (autoantigenic) | 3.7 | up | 0.00093 |
| AA416963 | 911 | EST | 3.69 | up | 0.03956 |
| AA496204 | 1397 | EST | 3.69 | up | 0.01097 |
| AA435526 | 1037 | transferrin receptor (p90, CD71) | 3.69 | up | 0.00139 |
| AA126459 | 248 | DKFZP566B023 protein | 3.69 | up | 0.00352 |
| H78323 | 2002 | transcription factor Dp-1 | 3.69 | up | 0.00326 |
| W73189 | 3586 | EphB2 | 3.68 | up | 0.02909 |
| AA029356 | 66 | EST | 3.68 | up | 0.01545 |
| C14051 | 1565 | phosphoprotein enriched in astrocytes 15 | 3.68 | up | 0.01453 |
| R38280 | 2830 | BCS1 (yeast homolog)-like | 3.68 | up | 0.0009 |
| X66401 | 3768 | proteasome (prosome, macropain) subunit, beta type, 9 (large multifunctional protease 2) | 3.68 | up | 0.01385 |
| X69398 | 3781 | CD47 antigen (Rh-related antigen, integrin-associated signal transducer) | 3.68 | up | 0.02332 |
| AA429470 | 996 | EST | 3.67 | up | 0.00782 |
| L25081 | 2180 | ras homolog gene family, member C | 3.67 | up | 0.00005 |
| M23613 | 2301 | nucleophosmin (nucleolar phosphoprotein B23, numatrin) | 3.67 | up | 0.00977 |
| AA328993 | 738 | EST | 3.66 | up | 0.00146 |
| W39183 | 3505 | KIAA0601 protein | 3.66 | up | 0.00018 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| AA211851 | 436 | EST | 3.66 | up | 0.00789 |
| X53331 | 3724 | matrix Gla protein | 3.66 | up | 0.04038 |
| AA621780 | 1530 | CGI-96 protein | 3.65 | up | 0.01582 |
| AA449122 | 1119 | EST | 3.65 | up | 0.00369 |
| W70336 | 3576 | EST | 3.65 | up | 0.01776 |
| AA029215 | 64 | adaptor-related protein complex 2, beta 1 subunit | 3.65 | up | 0.00037 |
| N27334 | 2470 | EST | 3.65 | up | 0.03437 |
| U37689 | 3355 | polymerase (RNA) II (DNA directed) polypeptide H | 3.65 | up | 0.00044 |
| D38073 | 1651 | minichromosome maintenance deficient (*S. cerevisiae*) 3 | 3.65 | up | 0.01869 |
| R49216 | 2879 | EST | 3.64 | up | 0.0004 |
| R87989 | 2978 | centrosome associated protein | 3.64 | up | 0.00008 |
| AA135407 | 292 | endogenous retroviral protease | 3.64 | up | 0.01086 |
| AA148977 | 322 | EST | 3.64 | up | 0.02911 |
| D63874 | 1714 | high-mobility group (nonhistone chromosomal) protein 1 | 3.64 | up | 0.00228 |
| AA454597 | 1166 | EST | 3.63 | up | 0.0067 |
| F04320 | 1786 | replication factor C (activator 1) 4 (37 kD) | 3.63 | up | 0.01119 |
| X68688 | 3777 | zinc finger protein 33a (KOX 31) | 3.62 | up | 0.00319 |
| R27432 | 2807 | EST | 3.62 | up | 0.00014 |
| AA401958 | 832 | EST | 3.62 | up | 0.01232 |
| HG2279-HT2375 | | triosephosphate isomerase 1 | 3.62 | up | 0.00192 |
| AA416973 | 913 | EST | 3.61 | up | 0.0091 |
| N62675 | 2593 | DEAD/H (Asp-Glu-Ala-Asp/His) box polypeptide 16 | 3.61 | up | 0.04034 |
| T15477 | 3058 | EST | 3.61 | up | 0.00005 |
| AA460017 | 1225 | EST | 3.61 | up | 0.00109 |
| D43950 | 1660 | chaperonin containing TCP1, subunit 5 (epsilon) | 3.61 | up | 0.00672 |
| N99505 | 2745 | EST | 3.6 | up | 0.04499 |
| AA443271 | 1073 | KIAA0546 protein | 3.6 | up | 0.01228 |
| N89937 | 2710 | LIM domain only 7 | 3.6 | up | 0.01375 |
| R71082 | 2950 | programmed cell death 5 | 3.6 | up | 0.01338 |
| AA412720 | 905 | EST | 3.6 | up | 0.01396 |
| X17567 | 3716 | small nuclear ribonucleoprotein polypeptides B and B1 | 3.59 | up | 0.00586 |
| AA399226 | 803 | tight junction protein 3 (zona occludens 3) | 3.59 | up | 0.02002 |
| R55470 | 2903 | EST | 3.59 | up | 0.00515 |
| X79234 | 3800 | ribosomal protein L11 | 3.58 | up | 0.00051 |
| D80917 | 1736 | KIAA0670 protein/acinus | 3.58 | up | 0.00007 |
| W81375 | 3610 | EST | 3.58 | up | 0.00322 |
| U89606 | 3451 | pyridoxal (pyridoxine, vitamin B6) kinase | 3.58 | up | 0.00322 |
| X05610 | 3682 | collagen, type IV, alpha 2 | 3.57 | up | 0.01351 |
| AA443941 | 1085 | tumor suppressing subtransferable candidate 1 | 3.57 | up | 0.01685 |
| N56935 | 2574 | EST | 3.57 | up | 0.00282 |
| N68385 | 2634 | ribosomal protein L13a | 3.57 | up | 0.00417 |
| R49084 | 2878 | KIAA0770 protein | 3.57 | up | 0.00447 |
| U83246 | 3442 | copine I | 3.56 | up | 0.01672 |
| AA182001 | 386 | EST | 3.56 | up | 0.00945 |
| N51342 | 2544 | EST | 3.56 | up | 0.0001 |
| W42627 | 3508 | EST | 3.56 | up | 0.00198 |
| X66364 | 3767 | cyclin-dependent kinase 5 | 3.55 | up | 0.02824 |
| AA451680 | 1136 | hepatocellular carcinoma associated protein; breast cancer associated gene 1 | 3.55 | up | 0.00708 |
| Z38909 | 3894 | EST | 3.55 | up | 0.03195 |
| T48293 | 3132 | EST | 3.55 | up | 0.01355 |
| W37680 | 3502 | EST | 3.55 | up | 0.01036 |
| AA252994 | 557 | apoptosis inhibitor 4 (survivin) | 3.55 | up | 0.00075 |
| AA134052 | 285 | Rab geranylgeranyltransferase, alpha subunit | 3.54 | up | 0.03062 |
| AA504806 | 1416 | EST | 3.54 | up | 0.00221 |
| T12599 | 3055 | ribosomal protein L21 | 3.54 | up | 0.01437 |
| L19527 | 2169 | ribosomal protein L27 | 3.54 | up | 0.00025 |
| U17760 | 3314 | laminin, beta 3 (nicein (125 kD), kalinin (140 kD), BM600 (125 kD)) | 3.54 | up | 0.01853 |
| AA056361 | 140 | integral membrane protein 2C | 3.53 | up | 0.02983 |
| H55437 | 1948 | kraken-like | 3.53 | up | 0.02344 |
| C14098 | 1566 | EST | 3.53 | up | 0.04401 |
| H98924 | 2072 | chromatin assembly factor 1, subunit A (p150) | 3.53 | up | 0.02106 |
| AA094517 | 202 | EST | 3.52 | up | 0.04805 |
| AA237017 | 521 | KIAA1068 protein | 3.52 | up | 0.00976 |
| T58607 | 3154 | EST | 3.52 | up | 0.04102 |
| AA028103 | 61 | EST | 3.52 | up | 0.01142 |
| M136547 | 302 | EST | 3.51 | up | 0.00308 |
| AA151182 | 332 | EST | 3.51 | up | 0.00043 |
| AA400271 | 814 | EST | 3.51 | up | 0.00742 |
| U93868 | 3462 | polymerase (RNA) III (DNA directed) (32 kD) | 3.5 | up | 0.01235 |
| W73914 | 3592 | EST | 3.5 | up | 0.04782 |
| AA482007 | 1331 | EST | 3.49 | up | 0.00167 |
| AA452259 | 1143 | EST | 3.49 | up | 0.00114 |
| HG3549-HT3549 | | ribosomal protein L10 | 3.49 | up | 0 |
| U79266 | 3433 | protein predicted by clone 23627 | 3.49 | up | 0.00004 |
| X07820 | 3692 | matrix metalloproteinase 10 (stromelysin 2) | 3.49 | up | 0.00689 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| H08863 | 1859 | hypothetical protein | 3.48 | up | 0.00205 |
| AA292659 | 710 | EST | 3.48 | up | 0.00037 |
| AA432162 | 1029 | DKFZP586B2022 protein | 3.48 | up | 0.03851 |
| T92935 | 3254 | EST | 3.48 | up | 0.03578 |
| X67247 | 3771 | mitogen-activated protein kinase kinase kinase kinase 3 | 3.48 | up | 0.00012 |
| AA426521 | 967 | Sjogren's syndrome nuclear autoantigen 1 | 3.47 | up | 0.01161 |
| AA489707 | 1371 | EST | 3.47 | up | 0.03433 |
| AA609008 | 1475 | EST | 3.46 | up | 0.02935 |
| L36720 | 2205 | bystin-like | 3.46 | up | 0.00094 |
| D21261 | 1629 | transgelin 2 | 3.46 | up | 0.00685 |
| AA446968 | 1097 | EST | 3.45 | up | 0.02232 |
| AA459310 | 1214 | EST | 3.45 | up | 0.00179 |
| N30436 | 2483 | EST | 3.45 | up | 0.02356 |
| AA410962 | 887 | peroxisome proliferative activated receptor, delta | 3.45 | up | 0.04574 |
| F02800 | 1780 | EST | 3.45 | up | 0.03238 |
| U14970 | 3304 | ribosomal protein S5 | 3.45 | up | 0.00915 |
| U26726 | 3335 | hydroxysteroid (11-beta) dehydrogenase 2 | 3.45 | up | 0.02342 |
| H17476 | 1889 | EST | 3.44 | up | 0.00479 |
| D19737 | 1623 | golgi autoantigen, golgin subfamily a, 3 | 3.44 | up | 0.02212 |
| U76366 | 3423 | Treacher Collins-Franceschetti syndrome 1 | 3.44 | up | 0.00021 |
| L40904 | 2212 | peroxisome proliferative activated receptor, gamma | 3.43 | up | 0.03511 |
| AA427442 | 971 | guanine nucleotide regulatory factor | 3.43 | up | 0.01547 |
| R77631 | 2966 | EST | 3.43 | up | 0.00006 |
| AA398761 | 799 | EST | 3.43 | up | 0.00726 |
| D80662 | 1733 | adaptor-related protein complex 1, gamma 2 subunit | 3.43 | up | 0.00108 |
| M77836 | 2400 | pyrroline-5-carboxylate reductase 1 | 3.43 | up | 0.00759 |
| T78922 | 3221 | stem cell growth factor; lymphocyte secreted C-type lectin | 3.42 | up | 0.02419 |
| N51053 | 2542 | eukaryotic translation initiation factor 5 | 3.42 | up | 0.01326 |
| AA134158 | 287 | EST | 3.42 | up | 0.0277 |
| AA454710 | 1168 | EST | 3.42 | up | 0.00653 |
| AA446949 | 1096 | EST | 3.41 | up | 0.03411 |
| AA164252 | 358 | VGF nerve growth factor inducible | 3.41 | up | 0.00154 |
| T59161 | 3158 | thymosin, beta 10 | 3.41 | up | 0.01885 |
| T35725 | 3112 | EST | 3.4 | up | 0.00149 |
| M60854 | 2367 | ribosomal protein S16 | 3.4 | up | 0.00001 |
| AA135871 | 294 | EST | 3.39 | up | 0.01544 |
| AA599244 | 1448 | KIAA0530 protein | 3.39 | up | 0.01246 |
| D25274 | 1632 | EST | 3.39 | up | 0.00238 |
| U33286 | 3348 | chromosome segregation 1 (yeast homolog)-like | 3.39 | up | 0.00939 |
| AA384184 | 774 | DKFZP586B0519 protein | 3.38 | up | 0.01209 |
| H04753 | 1839 | EST | 3.38 | up | 0.02447 |
| AA422049 | 937 | EST | 3.38 | up | 0.0067 |
| AA233886 | 475 | D site of albumin promoter (albumin D-box) binding protein | 3.38 | up | 0.0218 |
| U86409 | 3449 | EST | 3.38 | up | 0.00003 |
| X52851 | 3722 | EST | 3.38 | up | 0.0001 |
| U84720 | 3445 | RAE1 (RNA export 1, S.pombe) homolog | 3.37 | up | 0.03586 |
| M31520 | 2328 | ribosomal protein S24 | 3.37 | up | 0.00077 |
| AA458890 | 1206 | EST | 3.36 | up | 0.00303 |
| AA504413 | 1413 | EST | 3.35 | up | 0.00079 |
| AA001409 | 1 | EST | 3.35 | up | 0.04092 |
| AA251909 | 549 | EST | 3.35 | up | 0.03937 |
| AA461473 | 1242 | nebulette | 3.35 | up | 0.03855 |
| J04823 | 2115 | cytochrome c oxidase subunit VIII | 3.35 | up | 0.00075 |
| M26708 | 2311 | prothymosin, alpha (gene sequence 28) | 3.35 | up | 0.00064 |
| AA370163 | 766 | EST | 3.34 | up | 0.00643 |
| AA149889 | 326 | neighbor of A-kinase anchoring protein 95 | 3.34 | up | 0.02054 |
| U22376 | 3327 | v-myb avian myeloblastosis viral oncogene homolog | 3.34 | up | 0.03416 |
| C00021 | 1551 | stress-associated endoplasmic reticulum protein 1; ribosome associated membrane protein 4 | 3.33 | up | 0.00215 |
| AA156450 | 342 | EST | 3.33 | up | 0.00587 |
| AA338729 | 743 | EST | 3.33 | up | 0.00046 |
| D83783 | 1748 | trinucleotide repeat containing 11 (THR-associated protein, 230 kDa subunit) | 3.33 | up | 0.00748 |
| HG4542-HT4947 | | ribosomal protein L15 | 3.33 | up | 0.00023 |
| AA427825 | 981 | EST | 3.33 | up | 0.01615 |
| D43949 | 1659 | KIAA0082 protein | 3.32 | up | 0.0014 |
| D50913 | 1672 | KIAA0123 protein | 3.32 | up | 0.01202 |
| AA478599 | 1304 | G protein-coupled receptor 56 | 3.31 | up | 0.00182 |
| H93021 | 2033 | peptidylprolyl isomerase A (cyclophilin A) | 3.31 | up | 0.0183 |
| R53109 | 2898 | dimethylarginine dimethylaminohydrolase 2 | 3.31 | up | 0.02389 |
| AA132983 | 274 | DKFZP586G1517 protein | 3.31 | up | 0.01155 |
| H93652 | 2039 | ribosomal protein S5 | 3.31 | up | 0.00788 |
| T33508 | 3105 | phosphatidylinositol-4-phosphate 5-kinase, type II, beta | 3.31 | up | 0.00416 |
| M33197 | 2337 | glyceraldehyde-3-phosphate dehydrogenase | 3.31 | up | 0.00009 |
| H59617 | 1964 | EST | 3.3 | up | 0.04588 |
| D51287 | 1680 | ribosomal protein S12 | 3.3 | up | 0.02829 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| L20941 | 2174 | ferritin, heavy polypeptide 1 | 3.3 | up | 0.01172 |
| M91083 | 2418 | chromosome 11 open reading frame 13 | 3.3 | up | 0.00163 |
| Z68228 | 3944 | junction plakoglobin | 3.3 | up | 0.0237 |
| R73565 | 2958 | EST | 3.29 | up | 0.03489 |
| Z39200 | 3899 | EST | 3.29 | up | 0.00586 |
| AA084921 | 182 | ribosomal protein S10 | 3.29 | up | 0.04872 |
| T59668 | 3159 | lysyl oxidase | 3.28 | up | 0.00588 |
| AA280928 | 642 | EST | 3.27 | up | 0.04625 |
| AA397916 | 784 | EST | 3.27 | up | 0.02895 |
| D20464 | 1625 | bromodomain adjacent to zinc finger domain, 2B | 3.27 | up | 0.04897 |
| N73846 | 2679 | EST | 3.27 | up | 0.00012 |
| O80237 | 1729 | actin related protein 2/3 complex, subunit 4 (20 kD) | 3.27 | up | 0.00137 |
| T47032 | 3123 | partner of RAC1 (arfaptin 2) | 3.27 | up | 0.00503 |
| AA218663 | 444 | acid-inducible phosphoprotein | 3.26 | up | 0.03537 |
| T25725 | 3090 | EST | 3.26 | up | 0.00099 |
| X56932 | 3737 | ribosomal protein L13a | 3.26 | up | 0 |
| AA040465 | 95 | EST | 3.25 | up | 0.00146 |
| N62819 | 2594 | EST | 3.25 | up | 0.01137 |
| X51466 | 3717 | eukaryotic translation elongation factor 2 | 3.25 | up | 0.00019 |
| AA459961 | 1223 | EST | 3.24 | up | 0.00316 |
| AA488987 | 1365 | synaptogyrin 2 | 3.24 | up | 0.01444 |
| F01568 | 1772 | EST | 3.24 | up | 0.0018 |
| AA431776 | 1027 | EST | 3.24 | up | 0.01814 |
| AA464698 | 1262 | EST | 3.24 | up | 0.04854 |
| R54614 | 2901 | EST | 3.24 | up | 0.00526 |
| L76200 | 2223 | guanylate kinase 1 | 3.24 | up | 0.0097 |
| AA126429 | 247 | peroxisomal farnesylated protein | 3.23 | up | 0.00478 |
| AA405310 | 856 | EST | 3.23 | up | 0.00138 |
| AA427925 | 982 | EST | 3.23 | up | 0.01806 |
| AA133590 | 282 | EST | 3.23 | up | 0.03565 |
| H42321 | 1928 | ribosomal protein L18a | 3.23 | up | 0.01102 |
| T15903 | 3062 | EST | 3.23 | up | 0.01377 |
| AA127851 | 257 | EST | 3.23 | up | 0.01943 |
| R53109 | 2898 | dimethylarginine dimethylaminohydrolase 2 | 3.22 | up | 0.00724 |
| AA027946 | 60 | EST | 3.22 | up | 0.00098 |
| AA425401 | 954 | serine/threonine kinase 24 (Ste20, yeast homolog) | 3.22 | up | 0.00625 |
| AA449458 | 1127 | EST | 3.22 | up | 0.03098 |
| D60811 | 1704 | EST | 3.22 | up | 0.0098 |
| H96975 | 2057 | EST | 3.22 | up | 0.0141 |
| D23660 | 1630 | ribosomal protein L4 | 3.22 | up | 0.00316 |
| HG613-HT613 | | ribosomal protein S12 | 3.22 | up | 0.00761 |
| U01147 | 3274 | active BCR-related gene | 3.22 | up | 0.00103 |
| R26706 | 2802 | EST | 3.21 | up | 0.03858 |
| F02863 | 1782 | EST | 3.21 | up | 0.01039 |
| AA406385 | 876 | DKFZP564B0769 protein | 3.21 | up | 0.00724 |
| D78676 | 1719 | EST | 3.2 | up | 0.00635 |
| AA447732 | 1105 | EST | 3.2 | up | 0.00591 |
| AA458852 | 1203 | KIAA0440 protein | 3.2 | up | 0.00038 |
| AA397906 | 782 | DKFZP4341216 protein | 3.2 | up | 0.00138 |
| AA504111 | 1409 | EST | 3.2 | up | 0.00544 |
| U90549 | 3455 | high-mobility group (nonhistone chromosomal) protein 17-like 3 | 3.2 | up | 0.0401 |
| X13956 | 3698 | EST | 3.2 | up | 0.00321 |
| AA608965 | 1474 | Hermansky-Pudlak syndrome | 3.19 | up | 0.00204 |
| U62392 | 3402 | zinc finger protein 193 | 3.18 | up | 0.00269 |
| N58463 | 2579 | PCTAIRE protein kinase 1 | 3.18 | up | 0.00649 |
| AA436616 | 1056 | EST | 3.18 | up | 0.04402 |
| U40990 | 3358 | potassium voltage-gated channel, KQT-like subfamily, member 1 | 3.18 | up | 0.00093 |
| X56997 | 3738 | ubiquitin A-52 residue ribosomal protein fusion product 1 | 3.18 | up | 0.00006 |
| X69391 | 3780 | ribosomal protein L6 | 3.18 | up | 0.00003 |
| X78687 | 3797 | sialidase 1 (lysosomal sialidase) | 3.18 | up | 0.031 |
| X95404 | 3831 | cofilin 1 (non-muscle) | 3.18 | up | 0.00104 |
| AA258482 | 596 | zinc finger protein | 3.17 | up | 0.04606 |
| AA169837 | 364 | NADH dehydrogenase (ubiquinone) Fe-S protein 6 (13kD) (NADH-coenzyme Q reductase) | 3.17 | up | 0.03038 |
| AA479945 | 1319 | plakophilin 3 | 3.17 | up | 0.01767 |
| AA598506 | 1430 | KIAA0179 protein | 3.17 | up | 0.01694 |
| T26574 | 3095 | catenin (cadherin-associated protein), delta 1 | 3.17 | up | 0.00828 |
| D25216 | 1631 | KIAA0014 gene product | 3.17 | up | 0.02125 |
| D25328 | 1633 | phosphofructokinase, platelet | 3.17 | up | 0.04925 |
| X63527 | 3758 | ribosomal protein L19 | 3.17 | up | 0.02488 |
| M64716 | 2382 | ribosomal protein S25 | 3.16 | up | 0.00039 |
| HG1112-HT1112 | | EST | 3.15 | up | 0.04958 |
| HG2147-HT2217 | | mucin 3, intestinal | 3.15 | up | 0.0026 |
| D78361 | 1718 | EST | 3.14 | up | 0.00023 |
| Z38729 | 3891 | EST | 3.13 | up | 0.04514 |

TABLE 6A-continued

Up in Metastatics vs Normal Sample Set 2

| Fragment Name | SEQ ID: | Known Gene Name | Fold Change | Direction | Pvalue |
|---|---|---|---|---|---|
| AA192755 | 401 | EST | 3.13 | up | 0.00442 |
| AA194237 | 408 | EST | 3.13 | up | 0.00212 |
| M31520 | 2328 | ribosomal protein S24 | 3.13 | up | 0.00014 |
| AA410972 | 888 | EST | 3.12 | up | 0.00023 |
| D52632 | 1683 | ribosomal protein S6 | 3.12 | up | 0.00498 |
| HG2724-HT2820 | | DNA-damage-inducible transcript 3 | 3.12 | up | 0.03726 |
| X92518 | 3822 | high-mobility group (nonhistone chromosomal) protein isoform I-C | 3.12 | up | 0.00638 |
| AA402937 | 843 | EST | 3.11 | up | 0.00182 |
| N64616 | 2610 | EST | 3.11 | up | 0.0074 |
| H28333 | 1912 | melanoma adhesion molecule | 3.11 | up | 0.00172 |
| M14949 | 2264 | related RAS viral (r-ras) oncogene homolog | 3.11 | up | 0.00013 |
| U43901 | 3361 | laminin receptor 1 (67 kD, ribosomal protein SA) | 3.11 | up | 0.03145 |
| HG2815-HT2931 | | myosin, light polypeptide 6, alkali, smooth muscle and non-muscle | 3.11 | up | 0.00475 |
| X69654 | 3782 | ribosomal protein S26 | 3.11 | up | 0.02683 |
| AA402968 | 844 | EST | 3.1 | up | 0.00453 |
| N67205 | 2624 | EST | 3.1 | up | 0.00626 |
| N92915 | 2723 | brefeldin A-inhibited guanine nucleotide-exchange protein 1 | 3.1 | up | 0.00807 |
| D14530 | 1614 | ribosomal protein S23 | 3.1 | up | 0.00331 |
| M68864 | 2389 | ORF | 3.1 | up | 0.00603 |
| U14973 | 3307 | ribosomal protein S29 | 3.1 | up | 0.00028 |
| M36072 | 2347 | ribosomal protein L7a | 3.1 | up | 0.00006 |
| AA449479 | 1129 | EST | 3.09 | up | 0.03495 |
| D59847 | 1701 | EST | 3.09 | up | 0.02206 |
| AA194724 | 409 | endonuclease G | 3.09 | up | 0.04011 |
| AA412403 | 900 | EST | 3.09 | up | 0.00047 |
| U05875 | 3285 | interferon gamma receptor 2 (interferon gamma transducer 1) | 3.09 | up | 0.00549 |
| X80822 | 3805 | ribosomal protein L18a | 3.08 | up | 0.02481 |
| T58153 | 3153 | heatshock 105kD | 3.08 | up | 0.01317 |
| HG4319-HT4589 | | ribosomal protein L5 | 3.08 | up | 0.0017 |
| U67171 | 3408 | selenoprotein W, 1 | 3.08 | up | 0.0047 |
| L12711 | 2161 | transketolase (Wernicke-Korsakoff syndrome) | 3.08 | up | 0.03362 |
| N70577 | 2658 | EST | 3.07 | up | 0.01975 |
| Z39930 | 3911 | EST | 3.07 | up | 0.00002 |
| AA158795 | 352 | EST | 3.07 | up | 0.00057 |
| W37937 | | EST | 3.07 | up | 0.00776 |
| D79205 | 1721 | ribosomal protein L39 | 3.07 | up | 0.00021 |
| AA449475 | 1128 | EST | 3.06 | up | 0.00291 |
| N24899 | 2460 | EST | 3.06 | up | 0.00353 |
| Z38150 | 3880 | EST | 3.06 | up | 0.00049 |
| AA172076 | 369 | EST | 3.06 | up | 0.00326 |
| N90238 | 2711 | EST | 3.06 | up | 0.00354 |
| U27328 | 3337 | fucosyltransferase 3 (galactoside 3(4)-L-fucosyltransferase, Lewis blood group included) | 3.05 | up | 0.03224 |
| AA421638 | 935 | EST | 3.05 | up | 0.00487 |
| AA007158 | 15 | EST | 3.05 | up | 0.01964 |
| H24077 | 1900 | EST | 3.05 | up | 0.0324 |
| U36341 | 3350 | solute carrier family 6 (neurotransmitter transporter, creatine), member 8 | 3.05 | up | 0.02622 |
| U02493 | 3278 | non-Pou domain-containing octamer (ATGCAAAT) binding p | 3.04 | up | 0.0019 |
| N36432 | 2506 | erythrocyte membrane protein band 4.1-like 2 | 3.03 | up | 0.03086 |
| AA436473 | 1052 | EST | 3.03 | up | 0.00133 |
| AA598712 | 1436 | EST | 3.03 | up | 0.03656 |
| AA447118 | 1099 | EST | 3.03 | up | 0.01702 |
| H52673 | 1943 | BCL2-antagonist/killer 1 | 3.03 | up | 0.0393 |
| AA491223 | 1389 | EST | 3.03 | up | 0.00557 |
| T47969 | 3127 | ceroid-lipofuscinosis, neuronal 3, juvenile (Batten, Spielmeyer-Vogt disease) | 3.03 | up | 0.03452 |
| X03453 | 3674 | EST | 3.03 | up | 0.0025 |
| J03459 | 2093 | leukotriene A4 hydrolase | 3.03 | up | 0.04041 |
| M86667 | 2410 | nucleosome assembly protein 1-like 1 | 3.03 | up | 0.04853 |
| X80198 | 3804 | steroidogenic acute regulatory protein related | 3.03 | up | 0.00044 |
| W44733 | 3516 | EST | 3.02 | up | 0.00097 |
| X63629 | 3759 | cadherin 3, P-cadherin (placental) | 3.02 | up | 0.01654 |
| AA427946 | 983 | dynein, axonemal, light polypeptide 4 | 3.01 | up | 0.00001 |
| R45698 | 2865 | EST | 3.01 | up | 0.04766 |
| W49661 | 3536 | FK506-binding protein 9 (63 kD) | 3.01 | up | 0.02259 |
| R06986 | 2775 | peptidylprolyl isomerase B (cyclophilin B) | 3.01 | up | 0.04418 |
| W72861 | 3583 | protein tyrosine phosphatase, receptor type, f polypeptide (PTPRF), interacting protein (liprin), alpha 3 | 3.01 | up | 0.00055 |
| AA278838 | 620 | EST | 3 | up | 0.02832 |
| U03891 | 3282 | phorbolin (similar to apolipoprotein B mRNA editing protein) | 3 | up | 0.00065 |

TABLE 6B

Down in Metastatics vs Normal Sample Set 2

| Fragment Name | SEQ ID: | Known Gene Name | Fold Change | Direction | Pvalue |
|---|---|---|---|---|---|
| N54417 | 2566 | fibrinogen, A alpha polypeptide | 99.28 | down | 0.00001 |
| N53031 | 2555 | UDP glycosyltransferase 2 family, polypeptide B4 | 97.58 | down | 0.00022 |
| M15656 | 2268 | aldolase B, fructose-bisphosphate | 96.66 | down | 0 |
| T73442 | 3212 | EST | 94.41 | down | 0 |
| T59148 | 3157 | carbamoyl-phosphate synthetase 1, mitochondrial | 88.89 | down | 0 |
| R49459 | 2881 | transferrin receptor 2 | 85.61 | down | 0.00048 |
| X55283 | 3731 | asialoglycoprotein receptor 2 | 84.99 | down | 0.00084 |
| L16883 | 2166 | cytochrome P450, subfamily IIC (mephenytoin 4-hydroxylase), polypeptide 9 | 84.71 | down | 0.00327 |
| T48039 | 3128 | protein C (inactivator of coagulation factors Va and VIIIa) | 84.39 | down | 0.00112 |
| T71373 | 3202 | EST | 83.08 | down | 0.00069 |
| H58692 | 1960 | formyltetrahydrofolate dehydrogenase | 81.41 | down | 0 |
| T46901 | 3122 | EST | 77.28 | down | 0.0006 |
| M81349 | 2404 | serum amyloid A4, constitutive | 76.15 | down | 0.00015 |
| R43174 | 2847 | paraoxonase 1 | 74.04 | down | 0.00038 |
| X65727 | 3765 | glutathione S-transferase A2,glutathione S-transferase A3 | 73.64 | down | 0 |
| M16594 | 2272 | glutathione S-transferase A2 | 73.21 | down | 0 |
| U22029 | 3326 | cytochrome P450, subfamily IIA (phenobarbital-inducible), polypeptide 7 | 71.98 | down | 0 |
| AA256367 | 579 | paraoxonase 3 | 70.33 | down | 0.00192 |
| K03192 | 2127 | cytochrome P450, subfamily IIA (phenobarbital-inducible), polypeptide 6 | 69.92 | down | 0 |
| AA035245 | 79 | aldehyde oxidase 1 | 69.82 | down | 0.00117 |
| N80129 | 2702 | metallothionein 1L | 66.48 | down | 0.00415 |
| R97419 | 3003 | cytochrome P450, subfamily VIIIB (sterol 12-alpha-hydroxylase), polypeptide 1 | 65.07 | down | 0.0039 |
| T83356 | 3231 | apolipoprotein H (beta-2-glycoprotein I) | 64.34 | down | 0.00802 |
| AA348922 | 758 | fatty-acid-Coenzyme A ligase, long-chain 1,fatty-acid-Coenzyme A ligase, long-chain 2 | 64.27 | down | 0.00002 |
| T83397 | 3232 | phytanoyl-CoA hydroxylase (Refsum disease) | 63.6 | down | 0 |
| R16098 | 2792 | EST | 63.41 | down | 0.00038 |
| R89811 | 2979 | HGF activator | 62.51 | down | 0.00148 |
| H57166 | 1955 | EST | 60.76 | down | 0.00007 |
| N33009 | 2491 | apolipoprotein E | 60.54 | down | 0.0093 |
| N54053 | 2560 | secreted phosphoprotein 2, 24kD | 60.39 | down | 0.00087 |
| T68878 | 3190 | carboxylesterase 1 (monocyte/macrophage serine esterase 1) | 60.35 | down | 0.00409 |
| R08564 | 2779 | plasminogen-like | 60.18 | down | 0.00091 |
| F10182 | 1812 | hepsin (transmembrane protease, serine 1) | 58.92 | down | 0.00837 |
| L25880 | 2184 | epoxide hydrolase 1, microsomal (xenobiotic) | 58.7 | down | 0.00013 |
| W88946 | 3636 | putative glycine-N-acyltransferase | 58.26 | down | 0 |
| N54429 | 2567 | EST | 57.81 | down | 0.00724 |
| M29873 | 2318 | cytochrome P450, subfamily IIB (phenobarbital-inducible) | 56.71 | down | 0.0054 |
| AA476324 | 1281 | EST | 55.22 | down | 0.00132 |
| R12472 | 2788 | EST | 55.18 | down | 0.00011 |
| AA453988 | 1160 | methionine adenosyltransferase I, alpha | 54.29 | down | 0.00381 |
| T56264 | 3148 | apolipoprotein C-II | 53.04 | down | 0.00938 |
| W92148 | 3647 | kininogen | 51.09 | down | 0.00376 |
| R01023 | 2751 | glucokinase (hexokinase 4) regulatory protein | 50.71 | down | 0.00321 |
| H80901 | 2005 | ficolin (collagen/fibrinogen domain-containing) 3 (Hakata antigen) | 50.61 | down | 0.00262 |
| D31628 | 1646 | 4-hydroxyphenylpyruvate dioxygenase | 50.48 | down | 0.00002 |
| AA401562 | 830 | EST | 50.45 | down | 0.00301 |
| K03192 | 2127 | cytochrome P450, subfamily IIA (phenobarbital-inducible), polypeptide 6 | 50.16 | down | 0 |
| T67931 | 3183 | fibrinogen, B beta polypeptide | 49.55 | down | 0 |
| M16974 | 2277 | complement component 8, alpha polypeptide | 49.47 | down | 0.00046 |
| M12963 | 2248 | alcohol dehydrogenase 1 (class I), alpha polypeptide,alcohol dehydrogenase 2 (class I), beta polypeptide,alcohol dehydrogenase 3 (class I), gamma polypeptide | 48.95 | down | 0.00104 |
| T73433 | 3211 | angiotensinogen | 48.3 | down | 0.00049 |
| AA009719 | 20 | peroxisomal membrane protein 2 (22kD) | 47.12 | down | 0.00008 |
| H94666 | 2045 | alpha-1-B glycoprotein | 47.03 | down | 0.01158 |
| T98676 | 3268 | EST | 46.94 | down | 0.0001 |
| T40936 | 3117 | EST | 46.92 | down | 0.00056 |
| R98073 | 3008 | EST | 46.87 | down | 0 |
| AA456311 | 1190 | EST | 46.81 | down | 0.001 |
| H91325 | 2029 | aldolase B, frutose-bisphosphate | 45.85 | down | 0.00505 |
| H74317 | 1997 | apolipoprotein A-II | 45.09 | down | 0.01982 |
| T61373 | 3162 | vitronectin (serum spreading factor, somatomedin B, complement S-protein) | 44.9 | down | 0.3172 |
| X16260 | 3707 | inter-alpha (globulin) inhibitor, H1 polypeptide | 44.65 | down | 0.00933 |
| AA421049 | 927 | activating transcription factor 5 | 44.41 | down | 0.00179 |
| M17262 | 2278 | coagulation factor II (thrombin) | 44.3 | down | 0.00345 |
| HG1827–HT1856 | | cytochrome P450, subfamily IIC (mephenytoin 4-hydroxylase), polypeptide 18,cytochrome P450, subfamily IIC (mephenytoin 4-hydroxylase), polypeptide 8 | 44.17 | down | 0.0003 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA417046 | 915 | fatty-acid-Coenzyme A ligase, very long-chain 1 | 44 | down | 0 |
| AA433946 | 1033 | EST | 43.74 | down | 0.00005 |
| T71012 | 3200 | fibrinogen, B beta polypeptide | 43.61 | down | 0.00743 |
| L11244 | 2155 | complement component 4-binding protein, beta | 43.33 | down | 0 |
| AA018867 | 39 | EST | 42.87 | down | 0.00002 |
| T23882 | 3084 | kininogen | 42.85 | down | 0.00641 |
| L00190 | 2130 | antithrombin III | 42.41 | down | 0.00012 |
| N68596 | 2635 | betaine-homocysteine methyltransferase | 40.99 | down | 0 |
| H94475 | 2043 | alpha-2-plasmin inhibitor | 40.92 | down | 0.00271 |
| AA085987 | 183 | UDP glycosyltransferase 1 | 40.87 | down | 0.00004 |
| M75106 | 2396 | carboxypeptidase B2 (plasma) | 40.63 | down | 0 |
| HG2841–HT2968 | | albumin | 40.5 | down | 0.001 |
| M58600 | 2362 | heparin cofactor II | 39.79 | down | 0.00034 |
| R37128 | 2826 | complement component 4A | 39.51 | down | 0.00364 |
| R93776 | 2992 | EST | 39.32 | down | 0.00176 |
| M61855 | 2371 | cytochrome P450, subfamily IIC (mephenytoin 4-hydroxylase), polypeptide 9 | 38.82 | down | 0.00023 |
| X13930 | 3697 | cytochrome P450, subfamily IIA (phenobarbital-inducible), polypeptide 6 | 38.52 | down | 0 |
| T95813 | 3261 | KIAA1051 protein | 38.38 | down | 0.00008 |
| X68679 | 3776 | complement factor H related 3,complement factor H-related 4 | 38.22 | down | 0.00036 |
| W20094 | 3476 | DKFZP586A0522 protein | 38.09 | down | 0.00188 |
| AA479148 | 1311 | EST | 38.05 | down | 0 |
| AA235310 | 496 | EST | 37.86 | down | 0.00091 |
| T68711 | 3187 | EST | 37.65 | down | 0.00036 |
| R40395 | 2840 | lecithin-cholesterol acyltransferase | 37.33 | down | 0.00032 |
| W28944 | 3493 | EST | 37.07 | down | 0.00205 |
| U50929 | 3379 | betaine-homocysteine methyltransferase | 36.91 | down | 0 |
| L04751 | 2138 | cytochrome P450, subfamily IVA, polypeptide 11 | 36.79 | down | 0.00004 |
| N76012 | 2693 | EST | 36.71 | down | 0.00598 |
| T69284 | 3195 | mannose-binding lectin (protein C) 2, soluble (opsonic defect) | 36.53 | down | 0 |
| R49602 | 2884 | EST | 36.5 | down | 0.00001 |
| X07618 | 3688 | cytochrome P450, subfamily IID (debrisoquine, sparteine, etc., -metabolising), polypeptide 7a (pseudogene) | 35.79 | down | 0.00065 |
| N22938 | 2452 | serum amyloid A4, constitutive | 35.39 | down | 0.00128 |
| AA621131 | 1513 | EST | 35.37 | down | 0 |
| D12620 | 1601 | cytochrome P450, subfamily IVF, polypeptide 2,cytochrome P450, subfamily IVF, polypeptide 3 (leukotriene B4 omega hydroxylase) | 35.09 | down | 0.00015 |
| N70358 | 2656 | growth hormone receptor | 34.35 | down | 0 |
| N70966 | 2662 | solute carrier family 10 (sodium/bile acid cotransporter family), member 1 | 34.06 | down | 0.0006 |
| T68855 | 3188 | EST | 34.04 | down | 0 |
| T69029 | 3193 | haptoglobin | 33.18 | down | 0.02825 |
| M33317 | 2338 | cytochrome P450, subfamily IIA (phenobarbital-inducible), polypeptide 7 | 32.63 | down | 0 |
| T48075 | 3129 | hemoglobin, alpha 1 | 32.56 | down | 0.00172 |
| M12272 | 2243 | alcohol dehydrogenase 1 (class I), alpha polypeptide,alcohol dehydrogenase 2 (class I), beta polypeptide,alcohol dehydrogenase 3 (class I), gamma polypeptide | 32.42 | down | 0.0034 |
| AA620556 | 1505 | EST | 32.4 | down | 0.00353 |
| T74542 | 3214 | UDP glycosyltransferase 2 family, polypeptide B10 | 32.36 | down | 0.00004 |
| T56281 | 3150 | RNA helicase-related protein | 32.34 | down | 0.00002 |
| W73601 | 3589 | EST | 32.25 | down | 0 |
| M11567 | 2239 | angiogenin, ribonuclease, RNase A family, 5 | 32.25 | down | 0.0001 |
| W86600 | 3625 | EST | 32.14 | down | 0 |
| AA039335 | 89 | coagulation factor XII (Hageman factor) | 32 | down | 0.0029 |
| T67705 | 3182 | asialoglycoprotein receptor 2 | 31.6 | down | 0.00705 |
| H89980 | 2026 | protein phosphatase 1, regulatory (inhibitor) subunit 5 | 31.13 | down | 0.00006 |
| H20543 | 1897 | DKFZP586B1621 protein | 31.03 | down | 0.00074 |
| H57060 | 1954 | EST | 30.98 | down | 0.01687 |
| W67564 | 3568 | nuclear receptor subfamily 0, group B, member 2 | 30.34 | down | 0 |
| N74422 | 2685 | EST | 30.32 | down | 0 |
| X07173 | 3687 | inter-alpha (globulin) inhibitor, H2 polypeptide | 30.3 | down | 0.00016 |
| T47778 | 3126 | fibrinogen, A alpha polypeptide | 30 | down | 0.01401 |
| X90579 | 3816 | EST | 29.82 | down | 0.00273 |
| T99636 | 3270 | complement component 3 | 29.6 | down | 0.00051 |
| Z20777 | 3863 | EST | 29.59 | down | 0.00044 |
| U56814 | 3392 | deoxyribonuclease I-like 3 | 29.43 | down | 0.00003 |
| M19828 | 2287 | apolipoprotein B (including Ag(x) antigen) | 29.37 | down | 0.00137 |
| R77628 | 2965 | insulin induced gene 1 | 29.23 | down | 0.00122 |
| AA452158 | 1141 | ras homolog gene family, member B | 28.96 | down | 0.00064 |
| K02402 | 2125 | coagulation factor IX (plasma thromboplastic component, Christmas disease, hemophilia B) | 28.81 | down | 0.00001 |
| T57140 | 3151 | paraoxonase 3 | 28.8 | down | 0 |
| T68873 | 3189 | metallothionein 1L | 28.72 | down | 0.02953 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| H95569 | 2051 | DKFZP586A0522 protein | 28.48 | down | 0.00139 |
| T56279 | 3149 | H factor (complement)-like 3 | 28.39 | down | 0.00016 |
| N66066 | 2612 | EST | 28.35 | down | 0.00055 |
| X07732 | 3690 | hepsin (transmembrane protease, serine 1) | 28.21 | down | 0 |
| AA253216 | 561 | EST | 28.18 | down | 0.00141 |
| W79046 | 3599 | peroxisomal D3,D2-enoyl-CoA isomerase | 27.9 | down | 0.00023 |
| U51010 | 3380 | nicotinamide N-methyltransferase | 27.79 | down | 0.00366 |
| H08102 | 1858 | breast cell glutaminase | 27.77 | down | 0.00032 |
| U70732 | 3414 | glutamic-pyruvate transaminase (alanine aminotransferase) | 27.63 | down | 0 |
| HG2730–HT2828 | | fibrinogen, A alpha polypeptide | 27.34 | down | 0.001 |
| D90282 | 1769 | carbamoyl-phosphate synthetase 1, mitochondrial | 27.29 | down | 0.00002 |
| X53595 | 3726 | apolipoprotein H (beta-2-glycoprotein I) | 27.28 | down | 0.0066 |
| AA599937 | 1458 | insulin-like growth factor-binding protein 4 | 26.92 | down | 0.00094 |
| L25878 | 2183 | epoxide hydrolase 1, microsomal (xenobiotic) | 26.84 | down | 0 |
| Z30425 | 3875 | nuclear receptor subfamily 1, group I, member 3 | 26.64 | down | 0 |
| X16260 | 3707 | inter-alpha (globulin) inhibitor, H1 polypeptide | 26.39 | down | 0.0004 |
| R92475 | 2986 | flavin containing monooxygenase 3 | 26.13 | down | 0 |
| T61649 | 3164 | superoxide dismutase 2, mitochondrial | 26.09 | down | 0.00734 |
| N63845 | 2604 | phytanoyl-CoA hydroxylase (Refsum disease) | 25.92 | down | 0.00084 |
| X03168 | 3671 | vitronectin (serum spreading factor, somatomedin B, complement S-protein) | 25.88 | down | 0.00911 |
| H81070 | 2006 | RNA helicase-related protein | 25.74 | down | 0.0126 |
| T61801 | 3166 | hemopexin | 25.7 | down | 0.01362 |
| L47726 | 2219 | phenylalanine hydroxylase | 25.63 | down | 0.00019 |
| N59550 | 2587 | EST | 25.56 | down | 0.00024 |
| X56411 | 3734 | alcohol dehydrogenase 4 (class II), pi polypeptide | 25.14 | down | 0.00144 |
| HG2730–HT2827 | | fibrinogen, A alpha polypeptide | 25.1 | down | 0 |
| AA448300 | 1116 | FXYD domain-containing ion transport regulator 1 (phospholemman) | 24.97 | down | 0.00001 |
| N39201 | 2509 | protease inhibitor 4 (kallistatin) | 24.91 | down | 0.00253 |
| M34276 | 2341 | plasminogen | 24.73 | down | 0.00031 |
| Z28339 | 3872 | aldo-keto reductase family 1, member D1 (delta 4-3-ketosteroid-5-beta-reductase) | 24.66 | down | 0 |
| W72044 | 3577 | insulin induced gene 1 | 24.58 | down | 0.00001 |
| AA232114 | 463 | epoxide hydrolase 2, cytoplasmic | 24.34 | down | 0.00007 |
| U06641 | 3286 | UDP glycosyltransferase 2 family, polypeptide B15 | 24.32 | down | 0.00001 |
| H93381 | 2036 | EST | 24.23 | down | 0 |
| S68287 | 3024 | aldo-keto reductase family 1, member C4 (chlordecone reductase; 3-alpha hydroxysteroid dehydrogenase, type I; dihydrodiol dehydrogenase 4) | 24.11 | down | 0 |
| F04611 | 1792 | EST | 23.96 | down | 0.00018 |
| M10058 | 2230 | asialoglycoprotein receptor 1 | 23.96 | down | 0 |
| L32179 | 2193 | arylacetamide deacetylase (esterase) | 23.83 | down | 0 |
| AA598419 | 1427 | translational inhibitor protein p14.5 | 23.6 | down | 0.00036 |
| F02028 | 1774 | EST | 23.48 | down | 0.00465 |
| N89302 | 2707 | HLA-B associated transcript-3 | 23.44 | down | 0.00192 |
| AA279676 | 630 | deoxyribonuclease I-like 3 | 23.35 | down | 0.00001 |
| U05861 | 3284 | aldo-keto reductase family 1, member C1 (dihydrodiol dehydrogenase 1; 20-alpha (3-alpha)-hydroxysteroid dehydrogenase) | 23.22 | down | 0.00002 |
| H09353 | 1866 | EST | 23.06 | down | 0.00094 |
| M93405 | 2423 | methylmalonate-semialdehyde dehydrogenase | 23.06 | down | 0 |
| S48983 | 3017 | serum amyloid A4, constitutive | 23.04 | down | 0.00022 |
| AA443936 | 1084 | EST | 22.96 | down | 0.00627 |
| N74025 | 2684 | deiodinase, iodothyronine, type I | 22.79 | down | 0 |
| M15517 | 2267 | EST | 22.76 | down | 0.03365 |
| M16973 | 2276 | complement component 8, beta polypeptide | 22.75 | down | 0.00001 |
| X86401 | 3812 | glycine amidinotransferase (L-arginine:glycine amidinotransferase) | 22.7 | down | 0 |
| D16626 | 1622 | histidine ammonia-lyase | 22.66 | down | 0 |
| J02843 | 2088 | cytochrome P450, subfamily IIE (ethanol-inducible) | 22.58 | down | 0.00935 |
| U22961 | 3329 | albumin | 22.22 | down | 0.01531 |
| AA486511 | 1349 | EST | 22.21 | down | 0.00113 |
| L48516 | 2220 | paraoxonase 3 | 22.21 | down | 0.00004 |
| M62486 | 2374 | complement component 4-binding protein, alpha | 22.08 | down | 0.00272 |
| D00003 | 1586 | cytochrome P450, subfamily IIIA (niphedipine oxidase), polypeptide 3 | 22.05 | down | 0.00059 |
| J03810 | 2099 | solute carrier family 2 (facilitated glucose transporter), member 2 | 21.99 | down | 0.00004 |
| AA219304 | 447 | alpha-2-macroglobulin | 21.97 | down | 0.00011 |
| R08615 | 2780 | homogentisate 1,2-dioxygenase (homogentisate oxidase) | 21.85 | down | 0.00026 |
| AA147646 | 317 | DKFZP586A0522 protein | 21.82 | down | 0 |
| AA292158 | 706 | EST | 21.79 | down | 0.00031 |
| D11835 | 1598 | low density lipoprotein receptor (familial hypercholesterolemia) | 21.76 | down | 0.00307 |
| T87174 | 3239 | EST | 21.71 | down | 0.00681 |
| M16961 | 2274 | alpha-2-HS-glycoprotein | 21.45 | down | 0.01175 |
| D78011 | 1717 | dihydropyrimidinase | 21.37 | down | 0.00003 |
| R98624 | 3012 | EST | 21.32 | down | 0 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| R65593 | 2934 | kynurenine 3-monooxygenase (kynurenine 3-hydroxylase) | 21.27 | down | 0.00007 |
| K02766 | 2126 | complement component 9 | 21.24 | down | 0 |
| AA171694 | 366 | ceruloplasmin (ferroxidase) | 21.23 | down | 0.00179 |
| T58775 | 3156 | small inducible cytokine subfamily A (Cys-Cys), member 16 | 21.18 | down | 0.00006 |
| N71542 | 2664 | kidney- and liver-specific gene | 21.05 | down | 0 |
| AA343142 | 751 | EST | 20.87 | down | 0.00003 |
| X12662 | 3694 | arginase, liver | 20.59 | down | 0 |
| R64131 | 2929 | EST | 20.58 | down | 0.01028 |
| M68516 | 2387 | protein C inhibitor (plasminogen activator inhibitor III) | 20.54 | down | 0 |
| L07765 | 2147 | carboxylesterase 1 (monocyte/macrophage serine esterase 1) | 20.53 | down | 0.00025 |
| D10040 | 1593 | fatty-acid-Coenzyme A ligase, long-chain 2 | 20.51 | down | 0 |
| D13243 | 1602 | pyruvate kinase, liver and RBC | 20.22 | down | 0 |
| X01038 | 3666 | apolipoprotein A-I,apolipoprotein C-III | 19.97 | down | 0.0275 |
| T78889 | 3220 | fibronectin 1 | 19.87 | down | 0.00912 |
| S95936 | 3040 | transferrin | 19.76 | down | 0.02009 |
| R59722 | 2915 | EST | 19.74 | down | 0.00016 |
| U08198 | 3291 | complement component 8, gamma polypeptide | 19.71 | down | 0 |
| AA148480 | 318 | flavin containing monooxygenase 5 | 19.64 | down | 0 |
| M83772 | 2408 | flavin containing monooxygenase 3 | 19.54 | down | 0 |
| X03350 | 3673 | alcohol dehydrogenase 2 (class I), beta polypeptide | 19.32 | down | 0.00001 |
| W86375 | 3623 | EST | 19.29 | down | 0.0061 |
| M76665 | 2397 | hydroxysteroid (11-beta) dehydrogenase 1 | 19.22 | down | 0.00004 |
| J02943 | 2090 | corticosteroid binding globulin | 18.98 | down | 0.00087 |
| T61389 | 3163 | haptoglobin | 18.95 | down | 0.04873 |
| J04093 | 2106 | UDP glycosyltransferase 1 | 18.92 | down | 0 |
| Y09616 | 3854 | carboxylesterase 2 (intestine, liver) | 18.78 | down | 0.00026 |
| Z40715 | 3920 | delta-6 fatty acid desaturase | 18.68 | down | 0.0007 |
| M13149 | 2250 | histidine-rich glycoprotein | 18.65 | down | 0.02974 |
| U32576 | 3346 | apolipoprotein C-IV | 18.59 | down | 0.00005 |
| X00129 | 3664 | retinol-binding protein 4, interstitial | 18.57 | down | 0.02378 |
| N69136 | 2644 | EST | 18.53 | down | 0.00366 |
| Z49269 | 3942 | small inducible cytokine subfamily A (Cys-Cys), member 14 | 18.46 | down | 0.00001 |
| M29874 | 2319 | cytochrome P450, subfamily IIB (phenobarbital-inducible) | 18.44 | down | 0.00081 |
| M11437 | 2238 | kininogen | 18.38 | down | 0.00006 |
| Y00317 | 3842 | UDP glycosyltransferase 2 family, polypeptide B4 | 18.34 | down | 0.00001 |
| L09229 | 2150 | fatty-acid-Coenzyme A ligase, long-chain 1,fatty-acid-Coenzyme A ligase, long-chain 2 | 18.34 | down | 0.00016 |
| U37055 | 3352 | macrophage stimulating 1 (hepatocyte growth factor-like),macrophage stimulating, pseudogene 9 | 18.28 | down | 0 |
| S68805 | 3025 | glycine amidinotransferase (L-arginine:glycine amidinotransferase) | 18.19 | down | 0.00083 |
| D49742 | 1668 | hyaluronan-binding protein 2 | 18.13 | down | 0.00012 |
| N49090 | 2532 | EST | 18 | down | 0.00501 |
| M20867 | 2291 | glutamate dehydrogenase 1 | 17.73 | down | 0.00002 |
| AA435985 | 1049 | EST | 17.7 | down | 0 |
| X95384 | 3830 | translational inhibitor protein p14.5 | 17.69 | down | 0.00048 |
| T51617 | 3137 | solute carrier family 22 (extraneuronal monoamine transporter), member 3 | 17.67 | down | 0.00018 |
| D59714 | 1700 | mitogen inducible 2 | 17.62 | down | 0.00014 |
| M11025 | 2235 | asialoglycoprotein receptor 2 | 17.56 | down | 0.00003 |
| M86873 | 2413 | plasminogen,plasminogen-like | 17.54 | down | 0 |
| AA292328 | 707 | activating transcription factor 5 | 17.51 | down | 0.00689 |
| HG1148–HT1148 | | EST | 17.51 | down | 0.00024 |
| D62518 | 1708 | EST | 17.49 | down | 0.00017 |
| AA424798 | 947 | EST | 17.45 | down | 0.00352 |
| L32140 | 2192 | afamin | 17.31 | down | 0.00003 |
| R02365 | 2754 | glucose-6-phosphatase, catalytic (glycogen storage disease type I, von Gierke disease) | 17.17 | down | 0.00124 |
| N54950 | 2572 | ketohexokinase (fructokinase) | 17.17 | down | 0.00078 |
| M10612 | 2232 | apolipoprotein C-II | 17.13 | down | 0.00746 |
| H30270 | 1915 | EST | 17.09 | down | 0.00001 |
| N73543 | 2674 | EST | 17 | down | 0.00003 |
| M20786 | 2290 | alpha-2-plasmin inhibitor | 16.95 | down | 0.00709 |
| U20530 | 3321 | secreted phosphoprotein 2, 24kD | 16.93 | down | 0 |
| Z39833 | 3910 | GTP-binding protein | 16.89 | down | 0.00034 |
| AA377087 | 771 | EST | 16.75 | down | 0.00002 |
| H47838 | 1936 | carboxypeptidase B2 (plasma) | 16.74 | down | 0.00002 |
| D00097 | 1588 | amyloid P component, serum | 16.72 | down | 0.00098 |
| AA236401 | 510 | EST | 16.71 | down | 0.00088 |
| T52813 | 3141 | putative lymphocyte G0/G1 switch gene | 16.71 | down | 0.03897 |
| W92713 | 3651 | EST | 16.55 | down | 0.00097 |
| H83109 | 2012 | EST | 16.55 | down | 0.00001 |
| T63490 | 3170 | EST | 16.54 | down | 0 |
| AA122345 | 238 | glutamate dehydrogenase 1 | 16.53 | down | 0.00004 |
| M11321 | 2237 | group-specific component (vitamin D binding protein) | 16.52 | down | 0.01416 |
| K02215 | 2124 | angiotensinogen | 16.51 | down | 0.00006 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA449267 | 1120 | EST | 16.44 | down | 0.00926 |
| N68974 | 2639 | EST | 16.44 | down | 0.00087 |
| R43799 | 2850 | EST | 16.35 | down | 0.00208 |
| N51773 | 2548 | EST | 16.32 | down | 0.0007 |
| L11005 | 2154 | aldehyde oxidase 1 | 16.3 | down | 0.00065 |
| N71935 | 2666 | multiple PDZ domain protein | 16.28 | down | 0 |
| M26393 | 2309 | acyl-Coenzyme A dehydrogenase, C-2 to C-3 short chain | 16.27 | down | 0.00007 |
| J05037 | 2116 | serine dehydratase | 16.24 | down | 0.00015 |
| M11437 | 2238 | kininogen | 16.19 | down | 0.02277 |
| T73739 | 3213 | alanine-glyoxylate aminotransferase (oxalosis I; hyperoxaluria I; glycolicaciduria; serine-pyruvate aminotransferase) | 16.18 | down | 0.00277 |
| AA404252 | 848 | lectin, mannose-binding, 1 | 16.15 | down | 0.00001 |
| M58569 | 2361 | EST | 16.15 | down | 0.00174 |
| J05428 | 2120 | UDP glycosyltransferase 2 family, polypeptide B7 | 16.14 | down | 0.00563 |
| AA194997 | 412 | EST | 16.12 | down | 0.00103 |
| X14690 | 3700 | pre-alpha (globulin) inhibitor, H3 polypeptide | 16.07 | down | 0.00438 |
| H77597 | 2000 | metallothionein 1H | 16.03 | down | 0.00675 |
| U08006 | 3289 | complement component 8, alpha polypeptide | 16 | down | 0.00111 |
| AA458946 | 1209 | EST | 15.88 | down | 0.00004 |
| M13699 | 2253 | ceruloplasmin (ferroxidase) | 15.85 | down | 0.00012 |
| M21642 | 2294 | antithrombin III | 15.82 | down | 0.01027 |
| W28824 | 3492 | EST | 15.8 | down | 0.00006 |
| H60595 | 1966 | progesterone binding protein | 15.8 | down | 0.01078 |
| R06746 | 2770 | EST | 15.77 | down | 0.00009 |
| AA236455 | 512 | EST | 15.71 | down | 0.00286 |
| AA253369 | 563 | EST | 15.59 | down | 0.00091 |
| AA479885 | 1318 | KIAA0843 protein | 15.57 | down | 0.00024 |
| AA455988 | 1184 | butyrobetaine (gamma), 2-oxoglutarate dioxygenase (gamma-butyrobetaine hydroxylase) | 15.54 | down | 0.00001 |
| AA381125 | 772 | EST | 15.48 | down | 0 |
| AA455403 | 1177 | EST | 15.46 | down | 0.01547 |
| U29953 | 3341 | pigment epithelium-derived factor | 15.33 | down | 0.00212 |
| AA456289 | 1189 | EST | 15.31 | down | 0.00004 |
| H93246 | 2035 | EST | 15.3 | down | 0.00233 |
| AA015768 | 34 | EST | 15.3 | down | 0.00008 |
| AA195656 | 418 | KIAA0977 protein | 15.29 | down | 0.00817 |
| M21642 | 2294 | antithrombin III | 15.23 | down | 0.02088 |
| X56692 | 3736 | C-reactive protein, pentraxin-related | 15.15 | down | 0.01884 |
| AA196287 | 420 | EST | 15.07 | down | 0.00001 |
| T48278 | 3131 | EST | 15.04 | down | 0.04751 |
| N66857 | 2619 | EST | 15.03 | down | 0.00005 |
| AA156565 | 344 | 4-nitrophenylphosphatase domain and non-neuronal SNAP25-like 1 | 15.01 | down | 0.01387 |
| N58326 | 2578 | EST | 14.97 | down | 0.00647 |
| W86431 | 3624 | protein C inhibitor (plasminogen activator inhibitor III) | 14.94 | down | 0.00152 |
| W79422 | 3601 | fumarylacetoacetate | 14.94 | down | 0.00059 |
| H58673 | 1959 | EST | 14.85 | down | 0.00005 |
| Y12711 | 3858 | progesterone binding protein | 14.83 | down | 0.00285 |
| N31741 | 2488 | serine hydroxymethyltransferase 1 (soluble) | 14.76 | down | 0.00001 |
| N57464 | 2575 | CCAAT/enhancer binding protein (C/EBP), delta | 14.69 | down | 0.00018 |
| X64877 | 3763 | H factor (complement)-like 3 | 14.6 | down | 0 |
| U24266 | 3330 | aldehyde dehydrogenase 4 (glutamate gamma-semialdehyde dehydrogenase; pyrroline-5-carboxylate dehydrogenase) | 14.54 | down | 0 |
| N91882 | 2719 | alpha2,3-sialyltransferase | 14.52 | down | 0.00024 |
| AA402224 | 836 | growth arrest and DNA-damage-inducible, gamma | 14.41 | down | 0.00012 |
| AA179004 | 377 | EST | 14.34 | down | 0.00008 |
| AA034030 | 75 | methylmalonyl Coenzyme A mutase | 14.32 | down | 0.00004 |
| M17262 | 2278 | coagulation factor II (thrombin) | 14.24 | down | 0.00028 |
| U48707 | 3370 | protein phosphatase 1, regulatory (inhibitor) subunit 1A | 14.22 | down | 0 |
| L35546 | 2203 | glutamate-cysteine ligase (gamma-glutamylcysteine synthetase), regulatory (30.8kD) | 14.18 | down | 0.00018 |
| T74608 | 3215 | hydroxyacid oxidase (glycolate oxidase) 1 | 14.03 | down | 0 |
| U95090 | 3463 | nephrosis 1, congenital, Finnish type (nephrin) | 14.01 | down | 0.00018 |
| AA092716 | 198 | HLA-B associated transcript-3 | 13.97 | down | 0.00009 |
| D20350 | 1624 | EST | 13.97 | down | 0.00057 |
| Z49878 | 3943 | guanidinoacetate N-methyltransferase | 13.96 | down | 0.00021 |
| HG1428–HT1428 | | hemoglobin, beta | 13.89 | down | 0.01109 |
| X53414 | 3725 | alanine-glyoxylate aminotransferase (oxalosis I; hyperoxaluria I; glycolicaciduria; serine-pyruvate aminotransferase) | 13.87 | down | 0.00003 |
| M57731 | 2359 | GRO2 oncogene | 13.87 | down | 0.0123 |
| Z48475 | 3940 | glucokinase (hexokinase 4) regulatory protein | 13.84 | down | 0 |
| W86075 | 3621 | EST | 13.83 | down | 0.00057 |
| N57934 | 2576 | formiminotransferase cyclodeaminase | 13.81 | down | 0.00171 |
| AF000573 | 1543 | homogentisate 1,2-dioxygenase (homogentisate oxidase) | 13.76 | down | 0.00002 |
| R36989 | 2825 | hypothetical protein, estradiol-induced | 13.7 | down | 0.00056 |
| | | macrophage stimulating 1 (hepatocyte growth factor- | | | |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| N78850 | 2698 | like),macrophage stimulating, pseudogene 9 | 13.69 | down | 0.00421 |
| X63359 | 3756 | UDP glycosyltransferase 2 family, polypeptide B10 | 13.66 | down | 0.00051 |
| N80129 | 2702 | metallothionein 1L | 13.6 | down | 0.00196 |
| T61256 | 3161 | ketohexokinase (fructokinase) | 13.59 | down | 0.00425 |
| X07618 | 3688 | cytochrome P450, subfamily IID (debrisoquine, sparteine, etc., - metabolising), polypeptide 7a (pseudogene) | 13.58 | down | 0 |
| HG2383–HT4824 |  | cystathionine-beta-synthase | 13.57 | down | 0.00035 |
| X52520 | 3720 | tyrosine aminotransferase | 13.51 | down | 0.00002 |
| X98337 | 3837 | complement factor H related 3,complement factor H-related 4 | 13.5 | down | 0.00001 |
| T17411 | 3077 | transthyretin (prealbumin, amyloidosis type I) | 13.49 | down | 0.00203 |
| D12620 | 1601 | cytochrome P450, subfamily IVF, polypeptide 2,cytochrome P450, subfamily IVF, polypeptide 3 (leukotriene B4 omega hydroxylase) | 13.45 | down | 0 |
| N75870 | 2692 | dual specificity phosphatase 1 | 13.41 | down | 0.00251 |
| U01120 | 3273 | glucose-6-phosphatase, catalytic (glycogen storage disease type I, von Gierke disease) | 13.41 | down | 0.00147 |
| T58756 | 3155 | EST | 13.39 | down | 0.00013 |
| AA470153 | 1275 | solute carrier family 21 (organic anion transporter), member 9 | 13.26 | down | 0.00315 |
| T40995 | 3118 | alcohol dehydrogenase 3 (class I), gamma polypeptide | 13.25 | down | 0.01531 |
| R92768 | 2988 | EST | 13.2 | down | 0.00001 |
| AA148923 | 321 | decidual protein induced by progesterone | 13.2 | down | 0.00257 |
| D38535 | 1654 | inter-alpha (globulin) inhibitor H4 (plasma Kallikrein-sensitive glycoprotein) | 13.2 | down | 0.01165 |
| L21893 | 2176 | solute carrier family 10 (sodium/bile acid cotransporter family), member 1 | 13.18 | down | 0.00155 |
| AA259064 | 602 | EST | 13.15 | down | 0.00001 |
| N73561 | 2675 | EST | 12.96 | down | 0.00011 |
| X59766 | 3746 | alpha-2-glycoprotein 1, zinc | 12.96 | down | 0.00043 |
| AA233152 | 467 | EST | 12.95 | down | 0 |
| X72177 | 3787 | complement component 6 | 12.94 | down | 0.00011 |
| Z40902 | 3923 | SEC14 (*S. cerevisiae*)-like 2 | 12.87 | down | 0.00001 |
| X95190 | 3829 | acyl-Coenzyme A oxidase 2, branched chain | 12.81 | down | 0 |
| R52822 | 2895 | EST | 12.79 | down | 0.00001 |
| W95041 | 3659 | EST | 12.79 | down | 0.00001 |
| X13334 | 3696 | CD14 antigen | 12.77 | down | 0.00887 |
| D14012 | 1612 | HGF activator | 12.75 | down | 0.0035 |
| L12760 | 2162 | phosphoenolpyruvate carboxykinase 1 (soluble) | 12.75 | down | 0.00035 |
| R08850 | 2781 | EST | 12.55 | down | 0.00009 |
| AA608546 | 1463 | EST | 12.52 | down | 0.00003 |
| AA398280 | 792 | EST | 12.43 | down | 0.00134 |
| J03910 | 2101 | EST | 12.42 | down | 0.01167 |
| AA599814 | 1456 | EST | 12.37 | down | 0.00002 |
| W87532 | 3631 | putative glycine-N-acyltransferase | 12.34 | down | 0.00014 |
| M14338 | 2260 | protein S (alpha) | 12.33 | down | 0 |
| X64877 | 3763 | H factor (complement)-like 3 | 12.33 | down | 0 |
| R80048 | 2971 | EST | 12.28 | down | 0.00128 |
| R06726 | 2769 | protease inhibitor 1 (anti-elastase), alpha-1-antitrypsin | 12.26 | down | 0.03905 |
| AA405832 | 866 | EST | 12.24 | down | 0.00441 |
| M29194 | 2315 | lipase, hepatic | 12.18 | down | 0.00012 |
| W58756 | 3551 | EST | 12.17 | down | 0.00087 |
| T24106 | 3088 | EST | 12.13 | down | 0.01687 |
| AA402656 | 841 | EST | 12.05 | down | 0.00001 |
| L11244 | 2155 | complement component 4-binding protein, beta | 12.03 | down | 0.0001 |
| M65134 | 2385 | complement component 5 | 12.01 | down | 0.00012 |
| HG3543–HT3739 |  | insulin-like growth factor 2 (somatomedin A) | 11.97 | down | 0.00221 |
| L34081 | 2199 | bile acid Coenzyme A: amino acid N-acyltransferase (glycine N-choloyltransferase) | 11.96 | down | 0.00008 |
| U77594 | 3427 | retinoic acid receptor responder (tazarotene induced) 2 | 11.95 | down | 0.00527 |
| AA400258 | 812 | EST | 11.89 | down | 0.00478 |
| AA402799 | 842 | EST | 11.81 | down | 0.00031 |
| M94065 | 2424 | dihydroorotate dehydrogenase | 11.78 | down | 0.00034 |
| U76376 | 3424 | harakiri, BCL2-interacting protein (contains only BH3 domain) | 11.77 | down | 0.00002 |
| AA090257 | 190 | superoxide dismutase 2, mitochondrial | 11.72 | down | 0.02072 |
| AA021623 | 43 | insulin induced gene 1 | 11.71 | down | 0.00094 |
| W70115 | 3573 | histidine ammonia-lyase | 11.65 | down | 0.0003 |
| M69177 | 2391 | monoamine oxidase B | 11.64 | down | 0.00001 |
| X14813 | 3702 | acetyl-Coenzyme A acyltransferase 1 (peroxisomal 3-oxoacyl-Coenzyme A thiolase) | 11.61 | down | 0.0002 |
| AA461444 | 1239 | EST | 11.56 | down | 0.00167 |
| R73816 | 2960 | EST | 11.53 | down | 0.00259 |
| U31449 | 3344 | transmembrane 4 superfamily member 4 | 11.53 | down | 0.00187 |
| H55759 | 1949 | EST | 11.52 | down | 0.00034 |
| U27460 | 3338 | UDP-glucose pyrophosphorylase 2 | 11.46 | down | 0.00088 |
| H29568 | 1914 | EST | 11.45 | down | 0.00058 |
| AA194833 | 411 | claudin 1 | 11.45 | down | 0.00034 |
| AA176233 | 376 | EST | 11.44 | down | 0.01856 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| M74587 | 2393 | insulin-like growth factor binding protein 1 | 11.42 | down | 0.00274 |
| AA436560 | 1055 | claudin 1 | 11.41 | down | 0.00756 |
| Z69923 | 3945 | HGF activator | 11.37 | down | 0.00053 |
| U56814 | 3392 | deoxyribonuclease I-like 3 | 11.36 | down | 0.00001 |
| AA236455 | 512 | EST | 11.35 | down | 0.02859 |
| U13061 | 3301 | sulfotransferase family 2A, dehydroepiandrosterone (DHEA)-preferring, member 1 | 11.32 | down | 0.00048 |
| D49357 | 1665 | methionine adenosyltransferase I, alpha | 11.28 | down | 0.00331 |
| X04085 | 3675 | catalase | 11.27 | down | 0.0002 |
| M31994 | 2332 | aldehyde dehydrogenase 1, soluble | 11.24 | down | 0.01192 |
| R10287 | 2784 | EST | 11.2 | down | 0.0003 |
| Z31357 | 3877 | cysteine dioxygenase, type I | 11.2 | down | 0.0001 |
| T86482 | 3237 | transferrin | 11.15 | down | 0.00006 |
| D00408 | 1589 | cytochrome P450, subfamily IIIA (niphedipine oxidase), polypeptide 3,cytochrome P450, subfamily IIIA (niphedipine oxidase), polypeptide 5,cytochrome P450, subfamily IIIA, polypeptide 7 | 11.1 | down | 0 |
| AA074885 | 161 | macrophage receptor with collagenous structure | 11.05 | down | 0.00786 |
| HG4533–HT4938 | | protease inhibitor 4 (kallistatin) | 11.01 | down | 0.00001 |
| H70554 | 1989 | EST | 10.99 | down | 0 |
| L38928 | 2209 | 5,10-methenyltetrahydrofolate synthetase (5-formyltetrahydrofolate cyclo-ligase) | 10.97 | down | 0.0267 |
| AA182568 | 388 | STAT induced STAT inhibitor-2 | 10.92 | down | 0.00099 |
| X01388 | 3667 | apolipoprotein C-III | 10.9 | down | 0.01246 |
| AA076326 | 170 | SEC14 (*S. cerevisiae*)-like 2 | 10.88 | down | 0.00616 |
| X06562 | 3683 | growth hormone receptor | 10.87 | down | 0.00001 |
| W89178 | 3638 | transferrin receptor 2 | 10.85 | down | 0.00116 |
| D13643 | 1609 | KIAA0018 gene product | 10.84 | down | 0.00058 |
| R62519 | 2925 | EST | 10.83 | down | 0.00243 |
| AA454159 | 1162 | EST | 10.81 | down | 0.00132 |
| R94674 | 2995 | EST | 10.76 | down | 0.00008 |
| H12593 | 1880 | zinc-finger protein 265 | 10.72 | down | 0.0056 |
| H61295 | 1968 | CD4 antigen (p55) | 10.71 | down | 0.00925 |
| AA489636 | 1370 | EST | 10.7 | down | 0 |
| D10511 | 1594 | acetyl-Coenzyme A acetyltransferase 1 (acetoacetyl Coenzyme A thiolase) | 10.68 | down | 0.0002 |
| M14091 | 2257 | thyroxin-binding globulin | 10.66 | down | 0.0024 |
| AA425294 | 952 | EST | 10.61 | down | 0.00083 |
| AA347674 | 753 | EST | 10.59 | down | 0.03716 |
| C20653 | 1578 | EST | 10.59 | down | 0.00001 |
| D31815 | 1648 | regucalcin (senescence marker protein-30) | 10.55 | down | 0.00037 |
| T51150 | 3136 | EST | 10.52 | down | 0.00377 |
| Y00451 | 3845 | aminolevulinate, delta-, synthase 1 | 10.52 | down | 0.00107 |
| N67893 | 2628 | EST | 10.48 | down | 0.00341 |
| T64575 | 3171 | EST | 10.46 | down | 0.00014 |
| AA150776 | 330 | EST | 10.45 | down | 0.00015 |
| R93714 | 2991 | fetuin B | 10.42 | down | 0.00043 |
| T72171 | 3205 | thyroxin-binding globulin | 10.41 | down | 0.00163 |
| S77410 | 3034 | angiotensin receptor 1 | 10.4 | down | 0 |
| N49595 | 2537 | EST | 10.39 | down | 0.00022 |
| M13143 | 2249 | kallikrein B plasma, (Fletcher factor) 1 | 10.39 | down | 0.00019 |
| W90455 | 3643 | alpha-2-macroglobulin | 10.35 | down | 0.00063 |
| H11739 | 1876 | glycine dehydrogenase (decarboxylating; glycine decarboxylase, glycine cleavage system protein P) | 10.33 | down | 0.00023 |
| T71776 | 3203 | EST | 10.3 | down | 0.00897 |
| AA454177 | 1164 | EST | 10.3 | down | 0.0008 |
| N73988 | 2682 | EST | 10.27 | down | 0.00083 |
| L27050 | 2186 | apolipoprotein F | 10.26 | down | 0.00026 |
| K02100 | 2123 | ornithine carbamoyltransferase | 10.24 | down | 0.00009 |
| AA236365 | 509 | 3-phosphoglycerate dehydrogenase | 10.23 | down | 0.00562 |
| AA010750 | 28 | calmodulin 1 (phosphorylase kinase, delta) | 10.22 | down | 0.00959 |
| R45656 | 2864 | EST | 10.21 | down | 0.00179 |
| X04325 | 3676 | gap junction protein, beta 1, 32kD (connexin 32, Charcot-Marie-Tooth neuropathy, X-linked) | 10.17 | down | 0.00061 |
| R06002 | 2762 | EST | 10.15 | down | 0.00003 |
| T82323 | 3230 | immunoglobulin superfamily, member 4 | 10.14 | down | 0 |
| AA017146 | 36 | EST | 10.1 | down | 0.00052 |
| U32989 | 3347 | tryptophan 2,3-dioxygenase | 10.07 | down | 0.02825 |
| AA035457 | 80 | EST | 10.06 | down | 0.00085 |
| N89738 | 2709 | EST | 10.06 | down | 0.00052 |
| N94930 | 2740 | multiple PDZ domain protein | 10.06 | down | 0.00226 |
| M93143 | 2422 | plasminogen-like | 10.06 | down | 0.00098 |
| AA448002 | 1113 | putative type II membrane protein | 10.05 | down | 0 |
| M11313 | 2236 | alpha-2-macroglobulin | 10.05 | down | 0.00014 |
| M23234 | 2299 | ATP-binding cassette, sub-family B (MDR/TAP), member 4 | 10.05 | down | 0 |
| W90128 | 3640 | X-box binding protein 1 | 10.04 | down | 0.00018 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA284795 | 678 | phosphatidylethanolamine N-methyltransferase | 10.03 | down | 0.00019 |
| T39897 | 3113 | androgen induced protein | 10 | down | 0.00466 |
| Y00318 | 3843 | I factor (complement) | 10 | down | 0.00019 |
| T51930 | 3138 | EST | 9.99 | down | 0.00066 |
| N64036 | 2606 | enoyl-Coenzyme A, hydratase/3-hydroxyacyl Coenzyme A dehydrogenase | 9.99 | down | 0.00125 |
| AA235873 | 505 | H factor (complement)-like 1,H factor 1 (complement) | 9.98 | down | 0.01667 |
| AA421561 | 933 | insulin-like growth factor 2 (somatomedin A) | 9.98 | down | 0.00007 |
| R31641 | 2813 | EST | 9.96 | down | 0.00011 |
| AA490670 | 1379 | EST | 9.96 | down | 0.00454 |
| N59543 | 2586 | PDZ domain containing 1 | 9.96 | down | 0.00052 |
| S70004 | 3028 | glycogen synthase 2 (liver) | 9.96 | down | 0.00001 |
| R08548 | 2778 | EST | 9.94 | down | 0.00326 |
| Z11793 | 3861 | selenoprotein P, plasma, 1 | 9.94 | down | 0.00021 |
| AA035638 | 82 | EST | 9.91 | down | 0.00541 |
| AA223902 | 450 | EST | 9.91 | down | 0.00003 |
| AA452855 | 1150 | lectin, mannose-binding, 1 | 9.88 | down | 0.00428 |
| AA400915 | 823 | EST | 9.84 | down | 0.00351 |
| M17466 | 2279 | coagulation factor XII (Hageman factor) | 9.76 | down | 0.00285 |
| W67147 | 3565 | deleted in liver cancer 1 | 9.74 | down | 0.00002 |
| H10779 | 1872 | methylenetetrahydrofolate dehydrogenase (NADP+ dependent), methenyltetrahydrofolate cyclohydrolase, formyltetrahydrofolate synthetase | 9.73 | down | 0.00035 |
| R98413 | 3011 | EST | 9.71 | down | 0.00007 |
| N51117 | 2543 | EST | 9.68 | down | 0.00081 |
| J04813 | 2114 | cytochrome P450, subfamily IIIA (niphedipine oxidase), polypeptide 5 | 9.67 | down | 0.0107 |
| R91503 | 2981 | ATP-binding cassette, sub-family C (CFTR/MRP), member 2 | 9.64 | down | 0.00584 |
| X02176 | 3669 | complement component 9 | 9.61 | down | 0.00004 |
| D85181 | 1750 | sterol-C5-desaturase (fungal ERG3, delta-5-desaturase)-like | 9.56 | down | 0.00005 |
| R99591 | 3015 | CD5 antigen-like (scavenger receptor cysteine rich family) | 9.52 | down | 0.00006 |
| H56584 | 1951 | 4-nitrophenylphosphatase domain and non-neuronal SNAP25-like 1 | 9.5 | down | 0 |
| H94247 | 2041 | 3-hydroxy-3-methylglutaryl-Coenzyme A synthase 2 (mitochondrial) | 9.49 | down | 0.02373 |
| D00003 | 1586 | cytochrome P450, subfamily IIIA (niphedipine oxidase), polypeptide 3 | 9.46 | down | 0.00001 |
| R67970 | 2939 | gamma-glutamyl carboxylase | 9.45 | down | 0.00212 |
| N24879 | 2459 | EST | 9.44 | down | 0.00008 |
| T86978 | 3238 | glutamate dehydrogenase 1 | 9.44 | down | 0.00006 |
| N23665 | 2454 | hydroxysteroid (17-beta) dehydrogenase 2 | 9.4 | down | 0.00055 |
| W42789 | 3512 | EST | 9.38 | down | 0.00059 |
| U02388 | 3277 | cytochrome P450, subfamily IVF, polypeptide 2 | 9.38 | down | 0.00001 |
| AA039616 | 90 | EST | 9.36 | down | 0.00009 |
| N73883 | 2681 | EST | 9.35 | down | 0 |
| X16349 | 3709 | sex hormone-binding globulin | 9.34 | down | 0.00007 |
| W61377 | 3559 | EST | 9.33 | down | 0.0012 |
| H38246 | 1917 | EST | 9.25 | down | 0.00157 |
| D16626 | 1622 | histidine ammonia-lyase | 9.25 | down | 0.00025 |
| W87606 | 3632 | protein Z, vitamin K-dependent plasma glycoprotein | 9.23 | down | 0.00085 |
| AA312946 | 731 | EST | 9.21 | down | 0.00106 |
| R98074 | 3009 | EST | 9.21 | down | 0.00048 |
| R64199 | 2932 | SEC22, vesicle trafficking protein (*S. cerevisiae*)-like 1 | 9.19 | down | 0.00387 |
| AA419608 | 925 | EST | 9.19 | down | 0.00005 |
| AA459690 | 1221 | EST | 9.18 | down | 0.00732 |
| N72695 | 2670 | EST | 9.18 | down | 0.00069 |
| U49082 | 3372 | transporter protein | 9.17 | down | 0.00088 |
| AA291323 | 699 | BCL2-interacting killer (apoptosis-inducing) | 9.15 | down | 0.00514 |
| M25079 | 2305 | hemoglobin, beta | 9.15 | down | 0.01399 |
| AA430028 | 1008 | EST | 9.14 | down | 0.00246 |
| W55903 | 3543 | adipose differentiation-related protein; adipophilin | 9.12 | down | 0.00459 |
| AA083812 | 175 | DKFZP566F123 protein | 9.11 | down | 0.00167 |
| R40899 | 2843 | glycine receptor, beta | 9.11 | down | 0.0009 |
| AA099391 | 207 | myosin, light polypeptide kinase | 9.07 | down | 0.00003 |
| AA287566 | 690 | KIAA0187 gene product | 9.07 | down | 0.00013 |
| AA233369 | 471 | histidine ammonia-lyase | 9.06 | down | 0.0008 |
| AA443658 | 1079 | transmembrane 7 superfamily member 2 | 9.06 | down | 0.00048 |
| M14218 | 2259 | argininosuccinate lyase | 9.03 | down | 0.00078 |
| W44745 | 3517 | EST | 9.02 | down | 0.00276 |
| AA479968 | 1321 | arylsulfatase A | 9.01 | down | 0.00224 |
| AA193204 | 402 | Arg/Abl-interacting protein ArgBP2 | 8.98 | down | 0.00861 |
| D14664 | 1616 | KIAA0022 gene product | 8.98 | down | 0.00001 |
| Y00317 | 3842 | UDP glycosyltransferase 2 family, polypeptide B4 | 8.97 | down | 0.00025 |
| AA480975 | 1322 | EST | 8.95 | down | 0.00259 |
| AA282061 | 652 | KIAA0962 protein | 8.95 | down | 0.01033 |
| R32490 | 2817 | EST | 8.95 | down | 0.00215 |
| R40492 | 2841 | EST | 8.89 | down | 0.00229 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| N67876 | 2627 | insulin-like growth factor 1 (somatomedin C) | 8.89 | down | 0.00042 |
| T72502 | 3207 | EST | 8.87 | down | 0.00009 |
| T58032 | 3152 | 3-hydroxyanthranilate 3,4-dioxygenase | 8.86 | down | 0.00023 |
| AA487503 | 1356 | EST | 8.85 | down | 0.00012 |
| N94367 | 2739 | EST | 8.79 | down | 0.01003 |
| C21130 | 1583 | EST | 8.79 | down | 0.00008 |
| Z84721 | 3950 | hemoglobin, zeta | 8.77 | down | 0.01446 |
| AA609537 | 1483 | hepatic leukemia factor | 8.76 | down | 0.00018 |
| AA489798 | 1373 | hypothetical protein, estradiol-induced | 8.75 | down | 0.00544 |
| N32071 | 2490 | EST | 8.75 | down | 0.00006 |
| AA236796 | 517 | follistatin | 8.74 | down | 0.00862 |
| M37400 | 2348 | glutamic-oxaloacetic transaminase 1, soluble (aspartate aminotransferase 1) | 8.7 | down | 0.0004 |
| T90520 | 3248 | EST | 8.67 | down | 0.00072 |
| H59136 | 1962 | EST | 8.64 | down | 0.00013 |
| T78433 | 3219 | glycogen synthase 2 (liver) | 8.62 | down | 0.00072 |
| N81025 | 2704 | EST | 8.61 | down | 0.00015 |
| T66189 | 3177 | glutaryl-Coenzyme A dehydrogenase | 8.61 | down | 0.00003 |
| AA405819 | 865 | KIAA0668 protein | 8.59 | down | 0.02034 |
| AA480991 | 1323 | EST | 8.59 | down | 0.00156 |
| AA488843 | 1362 | cornichon-like | 8.58 | down | 0.02131 |
| AA521292 | 1422 | EST | 8.58 | down | 0.00064 |
| AA598417 | 1426 | UDP-N-acetylglucosamine-2-epimerase/N-acetylmannosamine kinase | 8.56 | down | 0.01638 |
| AA010619 | 27 | EST | 8.55 | down | 0.00057 |
| H95978 | 2052 | EST | 8.55 | down | 0.00046 |
| AA477978 | 1294 | short-chain dehydrogenase/reductase 1 | 8.53 | down | 0.01651 |
| AA491001 | 1386 | EST | 8.52 | down | 0.01118 |
| J05158 | 2117 | carboxypeptidase N, polypeptide 2, 83kD | 8.52 | down | 0 |
| AA112101 | 222 | EST | 8.5 | down | 0.00004 |
| X17094 | 3714 | paired basic amino acid cleaving enzyme (furin, membrane associated receptor protein) | 8.5 | down | 0 |
| AA101235 | 214 | EST | 8.46 | down | 0.00822 |
| X54380 | 3727 | pregnancy-zone protein | 8.44 | down | 0.00059 |
| AA406126 | 869 | EST | 8.43 | down | 0.00569 |
| M96843 | 2434 | EST | 8.42 | down | 0.02394 |
| N99542 | 2746 | orosomucoid 1 | 8.41 | down | 0.00001 |
| AA428325 | 988 | EST | 8.36 | down | 0.00002 |
| AA430011 | 1006 | EST | 8.35 | down | 0.00729 |
| AA182030 | 387 | EST | 8.32 | down | 0.00018 |
| W61378 | 3560 | EST | 8.31 | down | 0 |
| W03796 | 3467 | EST | 8.3 | down | 0.0032 |
| X60673 | 3749 | adenylate kinase 3 | 8.3 | down | 0.00016 |
| F08817 | 1796 | EST | 8.29 | down | 0.0077 |
| X15422 | 3705 | mannose-binding lectin (protein C) 2, soluble (opsonic defect) | 8.29 | down | 0.00015 |
| AA398423 | 795 | EST | 8.26 | down | 0.00063 |
| AA412063 | 895 | EST | 8.26 | down | 0.00001 |
| AA458652 | 1202 | EST | 8.26 | down | 0.00001 |
| AA126722 | 251 | O-6-methylguanine-DNA methyltransferase | 8.26 | down | 0.002 |
| R96822 | 2999 | EST | 8.25 | down | 0.00008 |
| R38709 | 2832 | superoxide dismultase 2, mitochondrial | 8.23 | down | 0.01578 |
| AA397841 | 780 | EST | 8.21 | down | 0 |
| Z40259 | 3916 | EST | 8.18 | down | 0.00002 |
| AA125831 | 241 | myosin, light polypeptide kinase | 8.18 | down | 0.00039 |
| D49387 | 1666 | NADP dependent leukotriene b4 12-hydroxydehydrogenase | 8.17 | down | 0.00972 |
| M58286 | 2360 | tumor necrosis factor receptor superfamily, member 1A | 8.15 | down | 0.00037 |
| W26769 | 3482 | CGI-86 protein | 8.14 | down | 0.00204 |
| AA609519 | 1482 | EST | 8.13 | down | 0.00009 |
| F10276 | 1814 | dual specificity phosphatase 6 | 8.13 | down | 0.0001 |
| R10378 | 2785 | fibrinogen-like 1 | 8.13 | down | 0.00189 |
| AA257057 | 586 | EST | 8.11 | down | 0.00379 |
| D52097 | 1682 | prostatic binding protein | 8.1 | down | 0.00141 |
| X76717 | 3794 | metallothionein 1L | 8.09 | down | 0.00025 |
| AA447971 | 1110 | EST | 8.08 | down | 0.00035 |
| AA486410 | 1348 | aldehyde dehydrogenase 5 family, member A1 (succinate-semialdehyde dehydrogenase) | 8.08 | down | 0.00485 |
| N34804 | 2496 | DKFZP434J214 protein | 8.08 | down | 0.00028 |
| AA167565 | 362 | EST | 8.08 | down | 0.00046 |
| AA234095 | 478 | EST | 8.08 | down | 0.00394 |
| AA489629 | 1369 | EST | 8.08 | down | 0.00109 |
| AA412481 | 902 | EST | 8.07 | down | 0.00014 |
| N52271 | 2551 | LIM protein (similar to rat protein kinase C-binding enigma) | 8.06 | down | 0.00011 |
| N94146 | 2738 | EST | 8.05 | down | 0 |
| AA004521 | 8 | prostate cancer overexpressed gene 1 | 8.03 | down | 0.00027 |
| R49035 | 2876 | EST | 8.02 | down | 0.00991 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| M59815 | 2364 | complement component 4A | 8.02 | down | 0.00049 |
| HG3044–HT3742 | | fibronectin 1 | 8.02 | down | 0.02094 |
| AA007629 | 19 | EST | 8.01 | down | 0.00001 |
| W33167 | 3498 | EST | 8.01 | down | 0.00026 |
| H98771 | 2069 | BCL2/adenovirus E1B 19kD-interacting protein 3 | 8 | down | 0.0018 |
| AA450127 | 1132 | growth arrest and DNA-damage-inducible, beta | 7.98 | down | 0.00078 |
| AA609316 | 1481 | EGF-like-domain, multiple 5 | 7.97 | down | 0.00011 |
| W87454 | 3629 | homogentisate 1,2-dioxygenase (homogentisate oxidase) | 7.93 | down | 0.00149 |
| N63698 | 2603 | EST | 7.92 | down | 0.00001 |
| Z24725 | 3867 | mitogen inducible 2 | 7.9 | down | 0 |
| Z30425 | 3875 | nuclear receptor subfamily 1, group I, member 3 | 7.88 | down | 0.00006 |
| F03969 | 1785 | matrix metalloproteinase 2 (gelatinase A, 72kD gelatinase, 72kD type IV collagenase) | 7.87 | down | 0.00014 |
| X68733 | 3778 | alpha-1-antichymotrypsin | 7.87 | down | 0.03266 |
| AA599211 | 1445 | short-chain dehydrogenase/reductase 1 | 7.85 | down | 0.00911 |
| AA079758 | 174 | solute carrier family 25 (mitochondrial carrier; citrate transporter), member 1 | 7.83 | down | 0.00359 |
| AA398124 | 787 | growth factor receptor-bound protein 14 | 7.82 | down | 0.00009 |
| AA416873 | 908 | EST | 7.82 | down | 0.00005 |
| M61853 | 2369 | cytochrome P450, subfamily IIC (mephenytoin 4-hydroxylase), polypeptide 18 | 7.82 | down | 0.00024 |
| W95795 | 3662 | EST | 7.8 | down | 0.00359 |
| R69417 | 2941 | EST | 7.79 | down | 0.03795 |
| AA430044 | 1010 | EST | 7.78 | down | 0.00124 |
| AA460449 | 1228 | EST | 7.77 | down | 0.00011 |
| R73485 | 2957 | EST | 7.77 | down | 0.0009 |
| W20467 | 3479 | EST | 7.76 | down | 0.00008 |
| AA481432 | 1328 | fibronectin 1 | 7.76 | down | 0.0061 |
| L29433 | 2191 | coagulation factor X | 7.74 | down | 0.00244 |
| AA261954 | 604 | EST | 7.69 | down | 0.00334 |
| T16484 | 3070 | EST | 7.69 | down | 0.00805 |
| AA443272 | 1074 | EST | 7.68 | down | 0.00869 |
| AA282516 | 660 | 7-dehydrocholesterol reductase | 7.67 | down | 0.0008 |
| AA459668 | 1219 | 3-hydroxyisobutyryl-Coenzyme A hydrolase | 7.62 | down | 0.00225 |
| AA431773 | 1026 | EST | 7.61 | down | 0.00063 |
| X92720 | 3823 | phosphoenolpyruvate carboxykinase 2 (mitochondrial) | 7.6 | down | 0.00001 |
| AA142849 | 306 | EST | 7.59 | down | 0.00804 |
| W90766 | 3646 | EST | 7.58 | down | 0.00057 |
| N40320 | 2513 | EST | 7.56 | down | 0.01584 |
| AA410255 | 882 | EST | 7.56 | down | 0.00043 |
| T72906 | 3209 | EST | 7.56 | down | 0.00062 |
| M65292 | 2386 | H factor (complement)-like 1,H factor 1 (complement) | 7.56 | down | 0.01152 |
| R59221 | 2911 | progesterone binding protein | 7.54 | down | 0.00159 |
| N77326 | 2695 | EST | 7.51 | down | 0.00542 |
| AA400864 | 821 | EST | 7.51 | down | 0.02237 |
| HG2379–HT3996 | | serine hydroxymethyltransferase 1 (soluble) | 7.49 | down | 0.00093 |
| AA234634 | 486 | CCAAT/enhancer binding protein (C/EBP), delta | 7.48 | down | 0.03318 |
| AA435777 | 1047 | solute carrier family 25 (mitochondrial carrier; citrate transporter), member 1 | 7.48 | down | 0.00613 |
| W73889 | 3591 | tetranectin (plasminogen-binding protein) | 7.45 | down | 0.00091 |
| X67491 | 3773 | glutamate dehydrogenase 1 | 7.45 | down | 0.00019 |
| AA292773 | 713 | collagen, type XVIII, alpha 1 | 7.44 | down | 0.00158 |
| U95090 | 3463 | nephrosis 1, congenital, Finnish type (nephrin) | 7.44 | down | 0.00004 |
| M65131 | 2384 | methylmalonyl Coenzyme A mutase | 7.44 | down | 0.00004 |
| AA398892 | 800 | similar to yeast BET3 (S. cerevisiae) | 7.43 | down | 0.00038 |
| AA621274 | 1519 | EST | 7.43 | down | 0.00065 |
| T72268 | 3206 | B-factor, properdin | 7.43 | down | 0.01197 |
| AA010205 | 23 | EST | 7.41 | down | 0 |
| R32440 | 2816 | EST | 7.41 | down | 0.00159 |
| N63391 | 2599 | EST | 7.39 | down | 0.00565 |
| M22976 | 2297 | cytochrome b-5 | 7.39 | down | 0.02431 |
| U08854 | 3292 | UDP glycosyltransferase 2 family, polypeptide B15 | 7.38 | down | 0.00005 |
| M12712 | 2246 | protein C (inactivator of coagulation factors Va and VIIIa) | 7.37 | down | 0.01866 |
| AA256341 | 578 | EST | 7.37 | down | 0.00091 |
| AA256171 | 575 | EST | 7.34 | down | 0.04562 |
| AA436489 | 1053 | EST | 7.34 | down | 0.001 |
| AA099225 | 206 | EST | 7.33 | down | 0.00062 |
| T77729 | 3217 | pyruvate carboxylase | 7.29 | down | 0.00022 |
| AA191310 | 397 | protein phosphatase 2 (formerly 2A), regulatory subunit A (PR 65), beta isoform | 7.28 | down | 0 |
| AA497052 | 1408 | DKFZP727G051 protein | 7.28 | down | 0.01745 |
| W85847 | 3616 | EST | 7.28 | down | 0.00024 |
| AA344866 | 752 | complement component 8, gamma polypeptide | 7.28 | down | 0.00206 |
| L11931 | 2159 | serine hydroxymethyltransferase 1 (soluble) | 7.27 | down | 0.00041 |
| AA429904 | 1005 | EST | 7.26 | down | 0.00524 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| T23986 | 3085 | hydroxacyl glutathione hydrolase; glyoxalase 2 | 7.26 | down | 0.0062 |
| AA459420 | 1217 | EST | 7.25 | down | 0.0214 |
| W94942 | 3658 | dual specificity phosphatase 10 | 7.23 | down | 0.00137 |
| L00972 | 2133 | cystathionine-beta-synthase | 7.19 | down | 0.00008 |
| R48307 | 2869 | EST | 7.18 | down | 0.00007 |
| AA442334 | 1069 | EST | 7.15 | down | 0.00018 |
| AA243582 | 529 | hemoglobin, gamma A | 7.15 | down | 0.0021 |
| AA437235 | 1060 | EST | 7.15 | down | 0.01455 |
| N67378 | 2625 | KIAA1053 protein | 7.14 | down | 0 |
| AA047151 | 116 | EST | 7.13 | down | 0.00007 |
| R02572 | 2756 | fibronectin 1 | 7.1 | down | 0.00059 |
| M63509 | 2376 | glutathione S-transferase M1,glutathione S-transferase M2 (muscle),glutathione S-transferase M4 | 7.06 | down | 0.03887 |
| U49248 | 3373 | ATP-binding cassette, sub-family C (CFTR/MRP), member 2 | 7.06 | down | 0.00067 |
| D90042 | 1767 | N-acetyltransferase 2 (arylamine N-acetyltransferase) | 7.06 | down | 0 |
| T67231 | 3180 | succinate dehydrogenase complex, subunit D, integral membrane protein | 7.04 | down | 0.03554 |
| AA293327 | 716 | isocitrate dehydrogenase 1 (NADP+), soluble | 7.04 | down | 0.04377 |
| X02750 | 3670 | protein C (inactivator of coagulation factors Va and VIIIa) | 7.04 | down | 0.00079 |
| AA460661 | 1229 | EST | 7.02 | down | 0.00053 |
| W28798 | 3491 | phosphodiesterase 6A, cGMP-specific, rod, alpha | 7.01 | down | 0.00017 |
| AA428900 | 992 | EST | 7.01 | down | 0.00037 |
| R33146 | 2818 | EST | 7 | down | 0.00043 |
| AA404352 | 850 | EST | 7 | down | 0.00059 |
| L40401 | 2211 | putative protein | 6.97 | down | 0.00079 |
| M31627 | 2330 | X-box binding protein 1 | 6.97 | down | 0.00052 |
| AA608802 | 1470 | EST | 6.95 | down | 0.00263 |
| AA285053 | 681 | EST | 6.95 | down | 0.00125 |
| N59474 | 2583 | EST | 6.93 | down | 0.00337 |
| AA258567 | 597 | EST | 6.92 | down | 0.00096 |
| N91087 | 2716 | EST | 6.91 | down | 0.00109 |
| N81036 | 2705 | EST | 6.89 | down | 0.00276 |
| H73535 | 1996 | EST | 6.89 | down | 0.00202 |
| Y00339 | 3844 | carbonic anhydrase II | 6.89 | down | 0 |
| AA057678 | 143 | EST | 6.88 | down | 0.00078 |
| AA609934 | 1493 | EST | 6.84 | down | 0.00048 |
| AA342446 | 748 | insulin receptor | 6.83 | down | 0.00412 |
| H06935 | 1855 | electron-transferring-flavoprotein dehydrogenase | 6.82 | down | 0.00105 |
| H27442 | 1910 | erythrocyte membrane protein band 7.2 (stomatin) | 6.81 | down | 0.00083 |
| D79276 | 1722 | succinate-CoA ligase, GDP-forming, beta subunit | 6.8 | down | 0.00047 |
| AA609164 | 1480 | cytochrome b-561 | 6.8 | down | 0.02298 |
| W27023 | 3484 | neuroendocrine-specific protein C like (foocen) | 6.79 | down | 0.00805 |
| N78902 | 2699 | leptin receptor | 6.79 | down | 0.0041 |
| X95715 | 3832 | ATP-binding cassette, sub-family C (CFTR/MRP), member 6 | 6.78 | down | 0.00045 |
| T95515 | 3260 | KIAA0249 gene product | 6.77 | down | 0.0001 |
| H69138 | 1986 | v-Ki-ras2 Kirsten rat sarcoma 2 viral oncogene homolog | 6.76 | down | 0.00142 |
| U68233 | 3411 | nuclear receptor subfamily 1, group H, member 4 | 6.76 | down | 0.00022 |
| AA143019 | 309 | EST | 6.75 | down | 0.00109 |
| T71021 | 3201 | EST | 6.74 | down | 0.0017 |
| M91432 | 2419 | acyl-Coenzyme A dehydrogenase, C-4 to C-12 straight chain | 6.74 | down | 0.00008 |
| AA205724 | 426 | EST | 6.73 | down | 0.00027 |
| N59532 | 2584 | aminomethyltransferase (glycine cleavage system protein T) | 6.73 | down | 0.00005 |
| T63364 | 3169 | ficolin (collagen/fibrinogen domain-containing) 3 (Hakata antigen) | 6.72 | down | 0.00383 |
| AA044755 | 104 | EST | 6.7 | down | 0.01228 |
| D59554 | 1698 | EST | 6.7 | down | 0 |
| H66367 | 1977 | EST | 6.68 | down | 0.0001 |
| X68277 | 3774 | dual specificity phosphatase 1 | 6.68 | down | 0.0036 |
| R50008 | 2886 | 7-dehydrocholesterol reductase | 6.67 | down | 0.00409 |
| D20974 | 1581 | Vanin 1 | 6.66 | down | 0.00272 |
| R82074 | 2973 | syndecan 1 | 6.66 | down | 0.01336 |
| M14058 | 2256 | complement component 1, r subcomponent | 6.66 | down | 0.00229 |
| AA400979 | 825 | calcitonin receptor-like receptor activity modifying protein 3 | 6.65 | down | 0.01051 |
| U03056 | 3279 | hyaluronoglucosaminidase 1 | 6.64 | down | 0 |
| AA215919 | 443 | F-box protein 7 | 6.62 | down | 0.00921 |
| AA426304 | 962 | EST | 6.61 | down | 0.01092 |
| AA251114 | 539 | prostate cancer overexpressed gene 1 | 6.6 | down | 0.00039 |
| T60407 | 3160 | EST | 6.6 | down | 0.00167 |
| AA416890 | 909 | sphingomyelin phosphodiesterase 1, acid lysosomal (acid sphingomyelinase) | 6.6 | down | 0.00112 |
| AA235233 | 493 | EST | 6.59 | down | 0.00755 |
| H04854 | 1842 | interleukin 1 receptor accessory protein | 6.58 | down | 0.00007 |
| M16447 | 2270 | quinoid dihydropteridine reductase | 6.57 | down | 0.00015 |
| C20911 | 1580 | antithrombin III | 6.56 | down | 0.00175 |
| N70861 | 2660 | EST | 6.55 | down | 0.00001 |
| AA010360 | 24 | EST | 6.55 | down | 0.00027 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| D00632 | 1591 | glutathione peroxidase 3 (plasma) | 6.55 | down | 0.00121 |
| T69009 | 3191 | quinoid dihydropteridine reductase | 6.54 | down | 0.00145 |
| M13829 | 2254 | v-raf murine sarcoma 3611 viral oncogene homolog 1 | 6.52 | down | 0 |
| M72885 | 2392 | putative lymphocyte G0/G1 switch gene | 6.5 | down | 0.03461 |
| AA172372 | 370 | EST | 6.48 | down | 0.00344 |
| D14695 | 1618 | KIAA0025 gene product; MMS-inducible gene | 6.48 | down | 0 |
| AA253129 | 560 | F-box protein FBL11 | 6.47 | down | 0.00001 |
| T03651 | 3046 | tubulin, beta polypeptide | 6.47 | down | 0.00843 |
| M94065 | 2424 | dihydroorotate dehydrogenase | 6.47 | down | 0.00013 |
| M35410 | 2344 | insulin-like growth factor binding protein 2 (36kD) | 6.45 | down | 0.04517 |
| Z40305 | 3917 | EST | 6.45 | down | 0.00001 |
| D60856 | 1705 | UDP-glucose dehydrogenase | 6.45 | down | 0.01222 |
| AA195657 | 419 | EST | 6.44 | down | 0.00016 |
| H05985 | 1851 | hypothetical protein | 6.43 | down | 0.04887 |
| AA281440 | 644 | EST | 6.43 | down | 0.01246 |
| W26996 | 3483 | EST | 6.42 | down | 0.00005 |
| U90544 | 3453 | solute carrier family 17 (sodium phosphate), member 2 | 6.42 | down | 0.00023 |
| M64590 | 2381 | glycine dehydrogenase (decarboxylating; glycine decarboxylase, glycine cleavage system protein P) | 6.41 | down | 0.00002 |
| H68953 | 1985 | transferrin | 6.4 | down | 0.00132 |
| M20218 | 2288 | coagulation factor XI (plasma thromboplastin antecedent) | 6.4 | down | 0.00004 |
| U26173 | 3334 | nuclear factor, interleukin 3 regulated | 6.4 | down | 0.00001 |
| Z29481 | 3874 | 3-hydroxyanthranilate 3,4-dioxygenase | 6.39 | down | 0.00029 |
| AA410523 | 886 | EST | 6.37 | down | 0.03506 |
| AA447549 | 1101 | UDP-N-acteylglucosamine pyrophosphorylase 1; Sperm associated antigen 2 | 6.37 | down | 0.02815 |
| X85116 | 3811 | erythrocyte membrane protein band 7.2 (stomatin) | 6.37 | down | 0.00356 |
| W72079 | 3578 | EST | 6.36 | down | 0.00641 |
| AA621209 | 1516 | similar to Caenorhabditis elegans protein C42C1.9 | 6.34 | down | 0.00144 |
| W68721 | 3569 | cleft lip and palate associated transmembrane protein 1 | 6.32 | down | 0.00063 |
| R38185 | 2828 | EST | 6.31 | down | 0.0227 |
| H41084 | 1924 | EST | 6.28 | down | 0.01233 |
| AA426609 | 968 | EST | 6.28 | down | 0.00549 |
| H05974 | 1850 | EST | | | |
| X83618 | 3810 | 3-hydroxy-3-methylglutaryl-Coenzyme A synthase 2 (mitochondrial) | 6.27 | down | 0.02099 |
| AA431337 | 1020 | EST | 6.26 | down | 0.00053 |
| AA234817 | 490 | EST | 6.22 | down | 0.00099 |
| AA398102 | 786 | KIAA0429 gene product | 6.22 | down | 0.00396 |
| AA481670 | 1330 | retinal short-chain dehydrogenase/reductase retSDR2 | 6.2 | down | 0.0078 |
| AA608837 | 1472 | EST | 6.2 | down | 0.00006 |
| N64535 | 2609 | EST | 6.19 | down | 0.00106 |
| AA234527 | 483 | nuclear receptor subfamily 3, group C, member 1 | 6.19 | down | 0.00864 |
| M10942 | 2233 | metallothionein 1E (functional) | 6.19 | down | 0.00428 |
| W42996 | 3514 | EST | 6.18 | down | 0.00587 |
| Z47553 | 3936 | flavin containing monooxygenase 5 | 6.17 | down | 0.00011 |
| N36001 | 2503 | EST | 6.16 | down | 0.00222 |
| N27670 | 2473 | progesterone membrane binding protein | 6.15 | down | 0.00321 |
| N75203 | 2690 | EST | 6.15 | down | 0.00181 |
| R06271 | 2765 | EST | 6.14 | down | 0.00063 |
| R40946 | 2844 | crystallin, zeta (quinone reductase) | 6.14 | down | 0.00156 |
| U66674 | 3407 | ATP-binding cassette, sub-family C (CFTR/MRP), member 3 | 6.13 | down | 0.00127 |
| D82061 | 1741 | Ke6 gene, mouse, human homolog of | 6.1 | down | 0.00104 |
| R06977 | 2774 | glucokinase (hexokinase 4) regulatory protein | 6.1 | down | 0.00049 |
| W87781 | 3633 | EST | 6.1 | down | 0.00045 |
| M15465 | 2266 | pyruvate kinase, liver and RBC | 6.1 | down | 0.00069 |
| AA609773 | 1489 | EST | 6.09 | down | 0.01103 |
| AA197311 | 422 | intercellular adhesion molecule 1 (CD54), human rhinovirus receptor | 6.07 | down | 0.00053 |
| M13690 | 2252 | complement component 1 inhibitor (angioedema, hereditary) | 6.07 | down | 0.00045 |
| R48540 | 2872 | EST | 6.05 | down | 0.00086 |
| AA453770 | 1157 | EST | 6.04 | down | 0.00524 |
| AA455097 | 1172 | EST | 6.03 | down | 0.00419 |
| D82422 | 1745 | ferroportin 1; iron regulated gene 1 | 6.01 | down | 0.02351 |
| F13702 | 1826 | EST | 6.01 | down | 0.00064 |
| M83652 | 2407 | properdin P factor, complement | 6 | down | 0.00002 |
| L11708 | 2158 | hydroxysteroid (17-beta) dehydrogenase 2 | 5.99 | down | 0.01516 |
| H71861 | 1993 | glucan (1,4-alpha-), branching enzyme 1 (glycogen branching enzyme, Andersen disease, glycogen storage disease type IV) | 5.97 | down | 0.00007 |
| X97324 | 3836 | adipose differentiation-related protein; adipophilin | 5.97 | down | 0.04638 |
| AA157799 | 348 | aldo-keto reductase family 7, member A2 (aflatoxin aldehyde reductase) | 5.96 | down | 0 |
| M35590 | 2345 | small inducible cytokine A4 | 5.96 | down | 0.00604 |
| H02855 | 1832 | EST | 5.96 | down | 0.00458 |
| C16420 | 1576 | EST | 5.95 | down | 0.00119 |
| X07767 | 3691 | protein kinase, cAMP-dependent, catalytic, alpha | 5.94 | down | 0.00028 |
| AA045870 | 108 | EST | 5.93 | down | 0.00017 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| Z80345 | 3948 | acyl-Coenzyme A dehydrogenase, C-2 to C-3 short chain | 5.93 | down | 0.0024 |
| N93764 | 2736 | EST | 5.92 | down | 0.0109 |
| AA031543 | 68 | translocation protein 1 | 5.92 | down | 0.00405 |
| AA620667 | 1506 | protein tyrosine phosphatase type IVA, member 1 | 5.92 | down | 0.00206 |
| M59499 | 2363 | tissue factor pathway inhibitor (lipoprotein-associated coagulation inhibitor) | 5.92 | down | 0.0005 |
| X91148 | 3818 | microsomal triglyceride transfer protein (large polypeptide, 88kD) | 5.91 | down | 0.00045 |
| R09053 | 2782 | EST | 5.9 | down | 0.0002 |
| Z39476 | 3905 | EST | 5.9 | down | 0.00687 |
| AA233347 | 470 | zinc finger protein 216 | 5.9 | down | 0.0041 |
| M13232 | 2251 | coagulation factor VII (serum prothrombin conversion accelerator) | 5.9 | down | 0.00014 |
| T69384 | 3197 | period (Drosophila) homolog 1 | 5.88 | down | 0.01219 |
| D51279 | 1679 | ovarian granulosa cell protein (13kD) | 5.88 | down | 0.01271 |
| M64554 | 2380 | coagulation factor XIII, B polypeptide | 5.87 | down | 0.00011 |
| C02099 | 1560 | CGI-131 protein | 5.85 | down | 0.02377 |
| Y08409 | 3851 | thyroid hormone responsive SPOT14 (rat) homolog | 5.84 | down | 0.00455 |
| H99727 | 2080 | adipose differentiation-related protein; adipophilin | 5.83 | down | 0.04346 |
| L13278 | 2163 | crystallin, zeta (quinone reductase) | 5.83 | down | 0.0034 |
| S77356 | 3033 | EST | 5.83 | down | 0.00122 |
| M16474 | 2271 | butyrylcholinesterase | 5.82 | down | 0.00113 |
| U32576 | 3346 | apolipoprotein C-IV | 5.81 | down | 0.04343 |
| D37931 | 1650 | ribonuclease, RNase A family, 4 | 5.81 | down | 0.00836 |
| AA446587 | 1091 | EST | 5.8 | down | 0.00012 |
| R93908 | 2993 | EST | 5.8 | down | 0.02699 |
| AA086201 | 185 | EST | 5.8 | down | 0.00012 |
| AA164586 | 359 | estrogen receptor 1 | 5.8 | down | 0.00182 |
| AF007216 | 1550 | solute carrier family 4, sodium bicarbonate cotransporter, member 4 | 5.79 | down | 0.00005 |
| AA479498 | 1314 | EST | 5.78 | down | 0.01489 |
| AA424813 | 948 | EST | 5.77 | down | 0.00503 |
| H03348 | 1833 | claudin 1 | 5.77 | down | 0.0001 |
| R62173 | 2923 | UDP-glucose dehydrogenase | 5.76 | down | 0.0006 |
| Z39976 | 3912 | EST | 5.76 | down | 0.00012 |
| AA219039 | 446 | EST | 5.76 | down | 0.00053 |
| AA608751 | 1469 | EST | 5.76 | down | 0.01404 |
| T95064 | 3259 | EST | 5.75 | down | 0.00604 |
| H09364 | 1867 | succinate dehydrogenase complex, subunit A, flavoprotein (Fp) | 5.74 | down | 0.03125 |
| T90841 | 3250 | EST | 5.74 | down | 0.01876 |
| T03441 | 3043 | cytochrome b-561 | 5.74 | down | 0.02781 |
| AA424307 | 944 | EST | 5.73 | down | 0.0074 |
| AA398386 | 793 | EST | 5.71 | down | 0.00007 |
| R43910 | 2851 | EST | 5.71 | down | 0 |
| U12778 | 3300 | acyl-Coenzyme A dehydrogenase, short/branched chain | 5.68 | down | 0.00116 |
| AA255903 | 573 | CD39-like 4 | 5.67 | down | 0.01687 |
| AA252289 | 552 | quinolinate phosphoribosyltransferase (nicotinate-nucleotide pyrophosphorylase (carboxylating)) | 5.66 | down | 0.01389 |
| AA262766 | 609 | EST | 5.66 | down | 0.03832 |
| T64887 | 3172 | protein phosphatase 5, catalytic subunit | 5.66 | down | 0.00349 |
| D11802 | 1597 | angiotensinogen | 5.65 | down | 0.00009 |
| D45714 | 1664 | EST | 5.64 | down | 0.00384 |
| U70732 | 3414 | glutamic-pyruvate transaminase (alanine aminotransferase) | 5.64 | down | 0.00146 |
| H88675 | 2022 | EST | 5.63 | down | 0.00554 |
| AA442342 | 1070 | EST | 5.62 | down | 0.00052 |
| T79863 | 3225 | EST | 5.62 | down | 0.00074 |
| AA454733 | 1169 | EST | 5.61 | down | 0.01182 |
| W72972 | 3584 | EST | 5.61 | down | 0.00939 |
| N95495 | 2741 | EST | 5.61 | down | 0.00308 |
| J03764 | 2097 | plasminogen activator inhibitor, type I | 5.6 | down | 0.02196 |
| L07956 | 2148 | glucan (1,4-alpha-), branching enzyme 1 (glycogen branching enzyme, Andersen disease, glycogen storage disease type IV) | 5.6 | down | 0.00029 |
| AA090439 | 192 | ribosomal protein S6 | 5.58 | down | 0.00501 |
| AA419507 | 924 | EST | 5.58 | down | 0.00578 |
| AA236982 | 520 | sterol carrier protein 2 | 5.56 | down | 0.01542 |
| L35546 | 2203 | glutamate-cysteine ligase (gamma-glutamylcysteine synthetase), regulatory (30.8kD) | 5.56 | down | 0.0005 |
| M16967 | 2275 | coagulation factor V (proaccelerin, labile factor) | 5.56 | down | 0.00047 |
| AB002328 | 1536 | calcineurin binding protein 1 | 5.55 | down | 0.00016 |
| AA450281 | 1134 | EST | 5.55 | down | 0.00004 |
| W47175 | 3531 | 3-prime-phosphoadenosine 5-prime-phosphosulfate synthase 2 | 5.54 | down | 0.00914 |
| N52845 | 2553 | EST | 5.53 | down | 0.00088 |
| AA425782 | 956 | KIAA0874 protein | 5.52 | down | 0.03433 |
| R10684 | 2787 | EST | 5.51 | down | 0.00741 |
| AA436926 | 1059 | EST | 5.5 | down | 0.00984 |
| AA452598 | 1148 | genethonin 1 | 5.49 | down | 0.00163 |
| D11756 | 1596 | EST | 5.49 | down | 0.01272 |
| AA223335 | 449 | propionyl Coenzyme A carboxylase, beta polypeptide | 5.49 | down | 0.02761 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| D87436 | 1761 | KIAA0249 gene product | 5.49 | down | 0.00333 |
| J04080 | 2105 | complement component 1, s subcomponent | 5.48 | down | 0.0239 |
| X65962 | 3766 | cytochrome P450, subfamily IIC (mephenytoin 4-hydroxylase) | 5.47 | down | 0.00014 |
| AA443822 | 1082 | EST | 5.46 | down | 0.02538 |
| AA485089 | 1341 | EST | 5.46 | down | 0.00044 |
| AA032048 | 72 | EST | 5.45 | down | 0.00383 |
| AA400471 | 816 | EST | 5.45 | down | 0.0056 |
| AA490159 | 1374 | glucose-6-phosphatase, transport (glucose-6-phosphate) protein 1 | 5.44 | down | 0 |
| M12174 | 2242 | ras homolog gene family, member B | 5.44 | down | 0.0088 |
| U11313 | 3296 | sterol carrier protein 2 | 5.44 | down | 0.00187 |
| N65959 | 2611 | EST | 5.43 | down | 0.00044 |
| AA482594 | 1337 | EST | 5.42 | down | 0.00387 |
| AA455865 | 1180 | phosphatidylinositol glycan, class B | 5.41 | down | 0.00004 |
| N23761 | 2456 | DKFZP586G011 protein | 5.41 | down | 0.00448 |
| U49352 | 3374 | 2,4-dienoyl CoA reductase 1, mitochondrial | 5.41 | down | 0.02371 |
| R63545 | 2926 | EST | 5.4 | down | 0.00202 |
| AA258308 | 590 | EST | 5.4 | down | 0.00023 |
| R34362 | 2821 | KIAA0327 gene product | 5.4 | down | 0.04615 |
| AA621192 | 1515 | EST | 5.39 | down | 0.0016 |
| T69020 | 3192 | EST | 5.39 | down | 0.00383 |
| AA598679 | 1434 | EST | 5.37 | down | 0.00467 |
| R43365 | 2849 | EST | 5.37 | down | 0.00103 |
| AA455987 | 1183 | EST | 5.36 | down | 0.00029 |
| C01257 | 1554 | EST | 5.35 | down | 0.00608 |
| D31716 | 1647 | basic transcription element binding protein 1 | 5.35 | down | 0.00086 |
| L05779 | 2140 | epoxide hydrolase 2, cytoplasmic | 5.35 | down | 0.00006 |
| AA490775 | 1380 | UDP-N-acetylglucosamine-2-epimerase/N-acetylmannosamine kinase | 5.34 | down | 0.00118 |
| R15825 | 2791 | KIAA0946 protein; Huntingtin interacting protein H | 5.33 | down | 0.00391 |
| AA342771 | 749 | EST | 5.33 | down | 0.00331 |
| F10466 | 1820 | EST | 5.32 | down | 0.02494 |
| S72370 | 3029 | pyruvate carboxylase | 5.31 | down | 0.00075 |
| N27834 | 2474 | alpha2,3-sialyltransferase | 5.31 | down | 0.00039 |
| D31117 | 1640 | ribosome binding protein 1 (dog 180kD homolog) | 5.3 | down | 0.02749 |
| AA032005 | 71 | EST | 5.3 | down | 0.01202 |
| N48315 | 2526 | adaptor-related protein complex 2, mu 1 subunit | 5.3 | down | 0.0149 |
| T08879 | 3048 | cathepsin F | 5.29 | down | 0.0008 |
| X02160 | 3668 | insulin receptor | 5.29 | down | 0.0001 |
| Z24459 | 3866 | mature T-cell proliferation 1 | 5.29 | down | 0.00001 |
| AA236230 | 508 | EST | 5.28 | down | 0.01517 |
| AA258353 | 593 | EST | 5.28 | down | 0.00193 |
| N64017 | 2605 | EST | 5.27 | down | 0.00022 |
| X90999 | 3817 | hydroxyacyl glutathione hydrolase; glyoxalase 2 | 5.27 | down | 0.00047 |
| AA347717 | 754 | EST | 5.25 | down | 0.00207 |
| U19523 | 3319 | GTP cyclohydrolase 1 (dopa-responsive dystonia) | 5.25 | down | 0.00029 |
| J04449 | 2110 | cytochrome P450, subfamily IIIA (niphedipine oxidase), polypeptide 3 | 5.25 | down | 0.01583 |
| AA428150 | 985 | EST | 5.24 | down | 0.00167 |
| N20113 | 2438 | EST | 5.24 | down | 0.01346 |
| N70057 | 2653 | DNA segment on chromosome 6 (unique) 49 expressed sequence | 5.24 | down | 0.01178 |
| N62652 | 2592 | EST | 5.23 | down | 0.03006 |
| AA461057 | 1234 | nuclear localization signal deleted in velocardiofacial syndrome | 5.22 | down | 0.00051 |
| X04828 | 3680 | guanine nucleotide binding protein (G protein), alpha inhibiting activity polypeptide 2 | 5.22 | down | 0.01278 |
| AA044842 | 105 | Autosomal Highly Conserved Protein | 5.21 | down | 0.0009 |
| AA005358 | 14 | EST | 5.2 | down | 0.00318 |
| N25082 | 2462 | amplified in osteosarcoma | 5.19 | down | 0.00895 |
| Z39059 | 3896 | EST | 5.19 | down | 0.0014 |
| J04056 | 2104 | carbonyl reductase 1 | 5.19 | down | 0.00001 |
| U00115 | 3271 | B-cell CLL/lymphoma 6 (zinc finger protein 51) | 5.18 | down | 0.00045 |
| AA046674 | 112 | EST | 5.17 | down | 0.02561 |
| C20810 | 1579 | EST | 5.17 | down | 0.00614 |
| L38928 | 2209 | 5,10-methenyltetrahydrofolate synthetase (5-formyltetrahydrofolate cyclo-ligase) | 5.17 | down | 0.00726 |
| L76687 | 2227 | growth factor receptor-bound protein 14 | 5.16 | down | 0.00199 |
| AA456055 | 1185 | EST | 5.16 | down | 0.00158 |
| H14372 | 1883 | ATP-binding cassette, sub-family A (ABC1), member 5 | 5.16 | down | 0.00012 |
| H88359 | 2020 | nuclear factor (erytroid-derived 2)-like 2 | 5.16 | down | 0.01253 |
| U60205 | 3400 | sterol-C4-methyl oxidase-like | 5.16 | down | 0.00061 |
| N79778 | 2701 | extracellular matrix protein 2, female organ and adipocyte specific | 5.15 | down | 0.00286 |
| H54285 | 1947 | EST | 5.14 | down | 0.00426 |
| M99439 | 2437 | transducin-like enhancer of split 4, homolog of Drosophila E(sp1) | 5.14 | down | 0.00001 |
| AA094999 | 204 | zinc finger protein 216 | 5.12 | down | 0.0257 |
| AA114949 | 228 | UDP-N-acetylglucosamine pyrophosphorylase 1; Sperm associated antigen 2 | 5.12 | down | 0.01028 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA430666 | 1016 | EST | 5.12 | down | 0.00377 |
| AA149253 | 323 | EST | 5.12 | down | 0.00863 |
| R48732 | 2875 | EST | 5.12 | down | 0.00837 |
| L36033 | 2204 | stromal cell-derived factor 1 | 5.1 | down | 0.00603 |
| F10875 | 1824 | EST | 5.09 | down | 0.00004 |
| H98083 | 2067 | EST | 5.09 | down | 0.00025 |
| AA258350 | 592 | EST | 5.08 | down | 0.00035 |
| AA191014 | 396 | EST | 5.07 | down | 0.01455 |
| AA478441 | 1302 | cathepsin F | 5.07 | down | 0.00752 |
| AA599472 | 1451 | succinate-CoA ligase, GDP-forming, beta subunit | 5.07 | down | 0.00447 |
| D79687 | 1723 | KIAA1053 protein | 5.06 | down | 0.00047 |
| H93053 | 2034 | glutamate-cysteine ligase (gamma-glutamylcysteine synthetase), catalytic (72.8kD) | 5.06 | down | 0.01029 |
| W45560 | 3522 | EST | 5.06 | down | 0.00996 |
| AA443756 | 1080 | EST | 5.05 | down | 0.00341 |
| D51199 | 1677 | EST | 5.05 | down | 0.00192 |
| AA620343 | 1500 | EST | 5.04 | down | 0.00407 |
| T15482 | 3059 | EST | 5.04 | down | 0.00233 |
| H46001 | 1931 | EST | 5.03 | down | 0.00563 |
| R51831 | 2890 | EST | 5.03 | down | 0.00761 |
| W57821 | 3545 | EST | 5.03 | down | 0.00277 |
| W63728 | 3562 | EST | 5.03 | down | 0.00311 |
| AA609574 | 1485 | EST | 5.03 | down | 0 |
| N62523 | 2591 | hepatic leukemia factor | 5.02 | down | 0.00087 |
| AA449306 | 1122 | EST | 5.01 | down | 0.0006 |
| AA279533 | 627 | EST | 5.01 | down | 0.04448 |
| N67105 | 2623 | EST | 5.01 | down | 0.00176 |
| S74728 | 3032 | antiquitin 1 | 5.01 | down | 0.00008 |
| AA070091 | 153 | EST | 5 | down | 0 |
| AA292086 | 705 | EST | 5 | down | 0.00161 |
| R82837 | 2975 | KIAA0970 protein | 5 | down | 0.00181 |
| AA486567 | 1350 | EST | 5 | down | 0.00002 |
| H78628 | 2003 | EST | 4.98 | down | 0.00729 |
| AA416936 | 910 | 5-methyltetrahydrofolate-homocysteine methyltransferase reductase | 4.98 | down | 0.00632 |
| AA400934 | 824 | EST | 4.98 | down | 0.02013 |
| D31381 | 1644 | dynein, axonemal, light polypeptide 4 | 4.97 | down | 0.01806 |
| AA210850 | 431 | EST | 4.97 | down | 0.00735 |
| L41067 | 2213 | nuclear factor of activated T-cells, cytoplasmic 3 | 4.96 | down | 0.00473 |
| AA450114 | 1131 | EST | 4.96 | down | 0.01238 |
| X92744 | 3824 | defensin, beta 1 | 4.96 | down | 0.01804 |
| X07619 | 3689 | cytochrome P450, subfamily IID (debrisoquine, sparteine, etc., -metabolising), polypeptide 7a (pseudogene) | 4.96 | down | 0.00004 |
| AA406125 | 868 | EST | 4.95 | down | 0.01027 |
| M95767 | 2431 | chitobiase, di-N-acetyl- | 4.94 | down | 0.00004 |
| H03945 | 1835 | EST | 4.94 | down | 0.02603 |
| X96752 | 3834 | L-3-hydroxyacyl-Coenzyme A dehydrogenase, short chain | 4.94 | down | 0.00359 |
| AA282089 | 653 | EST | 4.93 | down | 0.00108 |
| AA463194 | 1244 | KIAA1037 protein | 4.92 | down | 0.01866 |
| W81053 | 3607 | EST | 4.91 | down | 0.00164 |
| R06764 | 2771 | apolipoprotein B (including Ag(x) antigen) | 4.91 | down | 0.00167 |
| X58528 | 3745 | ATP-binding cassette, sub-family D (ALD), member 3 | 4.91 | down | 0.00728 |
| AA425309 | 953 | nuclear factor I/B | 4.9 | down | 0.00466 |
| AA451836 | 1137 | EST | 4.9 | down | 0.01412 |
| H91456 | 2030 | nuclear receptor subfamily 1, group H, member 4 | 4.9 | down | 0.00255 |
| W86850 | 3628 | solute carrier family 25 (mitochondrial carrier; citrate transporter), member 1 | 4.9 | down | 0.03105 |
| S69232 | 3026 | electron-transferring-flavoprotein dehydrogenase | 4.9 | down | 0.00017 |
| X62822 | 3755 | sialyltransferase 1 (beta-galactoside alpha-2,6-sialytransferase) | 4.89 | down | 0.00274 |
| W60002 | 3552 | plastin 3 (T isoform) | 4.88 | down | 0.01694 |
| U51333 | 3382 | hexokinase 3 (white cell) | 4.88 | down | 0.00055 |
| R56094 | 2904 | EST | 4.87 | down | 0.00214 |
| AA314457 | 733 | synaptonemal complex protein 3 | 4.86 | down | 0.0013 |
| N90820 | 2714 | DKFZP566B1346 protein | 4.86 | down | 0.03008 |
| T98199 | 3266 | EST | 4.86 | down | 0.00431 |
| D61991 | 1706 | EST | 4.84 | down | 0.00005 |
| AA446342 | 1088 | seven in absentia (Drosophila) homolog 1 | 4.84 | down | 0.00015 |
| U53003 | 3387 | ES1 (zebrafish) protein, human homolog of | 4.84 | down | 0.00077 |
| D87466 | 1763 | KIAA0276 protein | 4.83 | down | 0.0007 |
| D45556 | 1663 | EST | 4.83 | down | 0.01044 |
| AA046747 | 114 | EST | 4.82 | down | 0.00022 |
| AA464188 | 1256 | EST | 4.82 | down | 0.03208 |
| N26184 | 2466 | MYLE protein | 4.82 | down | 0.00056 |
| AA056482 | 141 | EST | 4.82 | down | 0.00199 |
| AA370359 | 767 | KIAA0382 protein; leukemia-associated rho guanine nucleotide exchange factor (GEF) | 4.82 | down | 0.01077 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| N54311 | 2563 | EST | 4.82 | down | 0.00183 |
| L07077 | 2145 | enoyl-Coenzyme A, hydratase/3-hydroxyacyl Coenzyme A dehydrogenase | 4.82 | down | 0.00403 |
| U68494 | 3412 | EST | 4.82 | down | 0.00881 |
| M55513 | 2354 | potassium voltage-gated channel, shaker-related subfamily, member 5 | 4.81 | down | 0.02141 |
| W74158 | 3593 | EST | 4.81 | down | 0.00233 |
| D16294 | 1619 | acetyl-Coenzyme A acyltransferase 2 (mitochondrial 3-oxoacyl-Coenzyme A thiolase) | 4.81 | down | 0.03921 |
| X13227 | 3695 | D-amino-acid oxidase | 4.81 | down | 0.0002 |
| AA417373 | 917 | EST | 4.8 | down | 0.01342 |
| F09350 | 1801 | EST | 4.79 | down | 0.00088 |
| AA233837 | 474 | EST | 4.79 | down | 0.0034 |
| N29353 | 2476 | kynurenine 3-monooxygenase (kynurenine 3-hydroxylase) | 4.78 | down | 0.00019 |
| AA291749 | 703 | estrogen receptor 1 | 4.78 | down | 0.00059 |
| AA461303 | 1238 | DKFZP586D1519 protein | 4.77 | down | 0.0438 |
| AA490620 | 1378 | EST | 4.77 | down | 0.00201 |
| H94648 | 2044 | EST | 4.77 | down | 0.00266 |
| AA228119 | 462 | pre-B-cell colony-enhancing factor | 4.77 | down | 0.00031 |
| AA449327 | 1123 | EST | 4.77 | down | 0.01248 |
| X00351 | 3665 | actin, beta | 4.76 | down | 0.0003 |
| L05144 | 2139 | phosphoenolpyruvate carboxykinase 1 (soluble) | 4.76 | down | 0.02289 |
| N49214 | 2535 | EST | 4.74 | down | 0.00064 |
| N59089 | 2580 | EST | 4.74 | down | 0.00055 |
| M35590 | 2345 | small inducible cytokine A4 | 4.74 | down | 0.01225 |
| T41047 | 3119 | EST | 4.74 | down | 0.00015 |
| M55671 | 2355 | protein Z, vitamin K-dependent plasma glycoprotein | 4.74 | down | 0.00078 |
| AA400834 | 820 | EST | 4.73 | down | 0.01523 |
| X57025 | 3739 | insulin-like growth factor 1 (somatomedin C) | 4.72 | down | 0.00087 |
| AA432168 | 1031 | S-adenosylhomocysteine hydrolase-like 1 | 4.71 | down | 0.01377 |
| AA435753 | 1045 | EST | 4.71 | down | 0.00078 |
| AA227452 | 455 | EST | 4.7 | down | 0.02345 |
| T70087 | 3199 | EST | 4.7 | down | 0.00173 |
| AA477919 | 1293 | EST | 4.69 | down | 0.00141 |
| AA194075 | 406 | nuclear receptor coactivator 4 | 4.69 | down | 0.00862 |
| AA424672 | 946 | dermatopontin | 4.69 | down | 0.00843 |
| U03105 | 3280 | proline-rich protein with nuclear targeting signal | 4.69 | down | 0.00017 |
| X78992 | 3799 | butyrate response factor 2 (EGF-response factor 2) | 4.69 | down | 0.01995 |
| W45051 | 3518 | EST | 4.68 | down | 0.00433 |
| W80609 | 3603 | EST | 4.68 | down | 0.01729 |
| N53549 | 2558 | cytochrome P450, subfamily IIJ (arachidonic acid epoxygenase) polypeptide 2 | 4.68 | down | 0.00818 |
| F09578 | 1804 | core-binding factor, runt domain, alpha subunit 2; translocated to, 3 | 4.66 | down | 0.04463 |
| H98071 | 2066 | EST | 4.66 | down | 0.03722 |
| N59283 | 2582 | EST | 4.65 | down | 0.02343 |
| N72259 | 2669 | cornichon-like | 4.65 | down | 0.0054 |
| X59812 | 3747 | cytochrome P450, subfamily XXVIIA (steroid 27-hydroxylase, cerebrotendinous xanthomatosis), polypeptide 1 | 4.65 | down | 0.036 |
| X78706 | 3798 | carnitine acetyltransferase | 4.65 | down | 0.00442 |
| M31169 | 2325 | propionyl Coenzyme A carboxylase, beta polypeptide | 4.65 | down | 0.00467 |
| R22905 | 2800 | EST | 4.64 | down | 0.0043 |
| D80050 | 1726 | EST | 4.64 | down | 0.01001 |
| AA258813 | 600 | EST | 4.63 | down | 0.02395 |
| AA256666 | 583 | EST | 4.63 | down | 0.0018 |
| AA004905 | 11 | KIAA0937 protein | 4.63 | down | 0.00082 |
| M35590 | 2345 | small inducible cytokine A4 | 4.62 | down | 0.01268 |
| AA069768 | 151 | hevin | 4.62 | down | 0.00202 |
| AA419622 | 926 | EST | 4.62 | down | 0.00386 |
| M27492 | 2312 | interleukin 1 receptor, type I | 4.62 | down | 0.0082 |
| AA090434 | 191 | diaphanous (Drosophila, homolog) 1 | 4.61 | down | 0.01704 |
| AA233763 | 472 | EST | 4.61 | down | 0.00004 |
| AA151210 | 333 | EST | 4.61 | down | 0.00008 |
| M23263 | 2300 | androgen receptor (dihydrotestosterone receptor; testicular feminization; spinal and bulbar muscular atrophy; Kennedy disease) | 4.6 | down | 0.00005 |
| H40149 | 1921 | KIAA0937 protein | 4.59 | down | 0.00112 |
| U19495 | 3318 | stromal cell-derived factor 1 | 4.59 | down | 0.00011 |
| AA436690 | 1057 | EST | 4.58 | down | 0.00948 |
| N29319 | 2475 | EST | 4.58 | down | 0.00011 |
| R64144 | 2931 | cAMP responsive element binding protein-like 2 | 4.58 | down | 0.00495 |
| T73420 | 3210 | short-chain dehydrogenase/reductase 1 | 4.58 | down | 0.00656 |
| D87449 | 1762 | KIAA0260 protein | 4.58 | down | 0.00026 |
| D12485 | 1600 | phosphodiesterase I/nucleotide pyrophosphatase 1 (homologous to mouse Ly-41 antigen) | 4.57 | down | 0.00008 |
| AA211388 | 433 | EST | 4.56 | down | 0.02703 |
| AA133215 | 277 | calcitonin receptor-like receptor activity modifying protein 1 | 4.55 | down | 0.02092 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA425836 | 957 | EST | 4.55 | down | 0.00035 |
| N45307 | 2517 | EST | 4.55 | down | 0.00006 |
| M12625 | 2245 | lecithin-cholesterol acyltransferase | 4.55 | down | 0.01584 |
| AA348284 | 755 | EST | 4.54 | down | 0.00759 |
| H10661 | 1871 | EST | 4.54 | down | 0.00276 |
| AA485413 | 1344 | EST | 4.54 | down | 0.00137 |
| C21238 | 1584 | EST | 4.54 | down | 0.02074 |
| S72370 | 3029 | pyruvate carboxylase | 4.54 | down | 0.0001 |
| AA521290 | 1421 | EST | 4.53 | down | 0.0148 |
| R92737 | 2987 | EST | 4.53 | down | 0.04447 |
| AA250775 | 537 | EST | 4.52 | down | 0.01752 |
| AA052980 | 122 | EST | 4.52 | down | 0.023 |
| AA253459 | 566 | EST | 4.51 | down | 0.00419 |
| N47942 | 2522 | progesterone membrane binding protein | 4.51 | down | 0.00168 |
| T25506 | 3089 | EST | 4.51 | down | 0.00529 |
| R59325 | 2913 | EST | 4.48 | down | 0.00117 |
| U77396 | 3425 | LPS-induced TNF-alpha factor | 4.47 | down | 0.00108 |
| AA280413 | 638 | spleen focus forming virus (SFFV) proviral integration oncogene spi1 | 4.46 | down | 0.02062 |
| AA406231 | 873 | KIAA0381 protein | 4.46 | down | 0.04049 |
| AA452454 | 1144 | EST | 4.45 | down | 0.00179 |
| AA431462 | 1022 | EST | 4.45 | down | 0.00956 |
| U79303 | 3435 | protein predicted by clone 23882 | 4.45 | down | 0 |
| AA621796 | 1531 | kinesin family member 3B | 4.44 | down | 0.00032 |
| L76571 | 2226 | nuclear receptor subfamily 0, group B, member 2 | 4.44 | down | 0.00312 |
| D57823 | 1690 | Sec23 (*S. cerevisiae*) homolog A | 4.43 | down | 0 |
| AA398257 | 791 | 7-dehydrocholesterol reductase | 4.43 | down | 0.04169 |
| AA214542 | 438 | EST | 4.43 | down | 0.00601 |
| Z48199 | 3939 | syndecan 1 | 4.43 | down | 0.00408 |
| H88033 | 2019 | KIAA0733 protein | 4.42 | down | 0.02032 |
| W69675 | 3572 | EST | 4.42 | down | 0.00019 |
| C01409 | 1556 | EST | 4.41 | down | 0.01725 |
| R94662 | 2994 | heme-binding protein | 4.41 | down | 0.02301 |
| N70305 | 2654 | EST | 4.41 | down | 0.00078 |
| AA262033 | 606 | EST | 4.41 | down | 0.00054 |
| H57816 | 1957 | EST | 4.41 | down | 0.00206 |
| N48787 | 2530 | protease inhibitor 1 (anti-elastase), alpha-1-antitrypsin | 4.4 | down | 0.00292 |
| R44025 | 2853 | EST | 4.4 | down | 0.01325 |
| Z39622 | 3907 | EST | 4.4 | down | 0.00001 |
| N73468 | 2673 | protein S (alpha) | 4.4 | down | 0.00853 |
| R36228 | 2823 | EST | 4.39 | down | 0.00033 |
| T71978 | 3204 | EST | 4.39 | down | 0.0017 |
| AA437265 | 1061 | EST | 4.39 | down | 0.00826 |
| N93155 | 2728 | calmodulin 1 (phosphorylase kinase, delta) | 4.39 | down | 0.0002 |
| Z38161 | 3881 | EST | 4.38 | down | 0.0011 |
| H98910 | 2071 | EST | 4.38 | down | 0.00548 |
| N23730 | 2455 | v-fos FBJ murine osteosarcoma viral oncogene homolog | 4.38 | down | 0.04395 |
| T69164 | 3194 | EST | 4.38 | down | 0.00548 |
| M31667 | 2331 | cytochrome P450, subfamily I (aromatic compound-inducible), polypeptide 2 | 4.38 | down | 0.00078 |
| AA193297 | 404 | EST | 4.37 | down | 0.04676 |
| AA427783 | 979 | EST | 4.37 | down | 0.0004 |
| N22434 | 2450 | EST | 4.37 | down | 0.01725 |
| W37382 | 3501 | EST | 4.37 | down | 0.00677 |
| AA282971 | 665 | EST | 4.37 | down | 0.03822 |
| D11881 | 1599 | KIAA0962 protein | 4.37 | down | 0.01627 |
| F09979 | 1809 | EST | 4.36 | down | 0.02555 |
| W92771 | 3652 | glycine cleavage system protein H (aminomethyl carrier) | 4.36 | down | 0.0064 |
| AA437295 | 1062 | ribosomal protein L7a | 4.35 | down | 0.00347 |
| AA452559 | 1147 | EST | 4.35 | down | 0.00804 |
| W90583 | 3645 | EST | 4.35 | down | 0.00318 |
| T97234 | 3264 | EST | 4.34 | down | 0.00263 |
| U57721 | 3394 | kynureninase (L-kynurenine hydrolase) | 4.34 | down | 0.0197 |
| T85532 | 3235 | EST | 4.33 | down | 0.00591 |
| AA421244 | 932 | SH3-domain binding protein 5 (BTK-associated) | 4.32 | down | 0.007 |
| N25969 | 2465 | protein kinase, cAMP-dependent, regulatory, type I, alpha (tissue specific extinguisher 1) | 4.32 | down | 0.00304 |
| W73818 | 3590 | EST | 4.32 | down | 0.00385 |
| S90469 | 3039 | P450 (cytochrome) oxidoreductase | 4.32 | down | 0.0182 |
| AA258613 | 598 | EST | 4.31 | down | 0.0344 |
| AA001603 | 3 | EST | 4.31 | down | 0.00883 |
| AA258323 | 591 | EST | 4.31 | down | 0.00046 |
| D60769 | 1703 | KIAA0096 protein | 4.31 | down | 0.00142 |
| U34252 | 3349 | aldehyde dehydrogenase 9 (gamma-aminobutyraldehyde dehydrogenase, E3 isozyme) | 4.31 | down | 0.00613 |
| AA431480 | 1023 | EST | 4.3 | down | 0.00876 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| N39163 | 2508 | metallothionein 1L | 4.3 | down | 0.03917 |
| M35878 | 2346 | insulin-like growth factor binding protein 3 | 4.3 | down | 0.0027 |
| Z11559 | 3859 | iron-responsive element binding protein 1 | 4.3 | down | 0.00066 |
| AA454086 | 1161 | UDP-glucose dehydrogenase | 4.29 | down | 0.00981 |
| X59834 | 3748 | glutamate-ammonia ligase (glutamine synthase) | 4.29 | down | 0.00255 |
| W58540 | 3550 | KIAA1131 protein | 4.28 | down | 0.0184 |
| T81315 | 3226 | EST | 4.28 | down | 0.00187 |
| AA398445 | 796 | EST | 4.28 | down | 0.01764 |
| AA521306 | 1423 | EST | 4.27 | down | 0.00567 |
| R99909 | 3016 | EST | 4.27 | down | 0.00045 |
| AA460012 | 1224 | solute carrier family 22 (extraneuronal monoamine transporter), member 3 | 4.27 | down | 0.04975 |
| U46499 | 3364 | microsomal glutathione S-transferase 1 | 4.27 | down | 0.00244 |
| M83216 | 2406 | caldesmon 1 | 4.27 | down | 0.00037 |
| AA136079 | 297 | EST | 4.26 | down | 0.0057 |
| L40401 | 2211 | putative protein | 4.26 | down | 0.00194 |
| D31887 | 1649 | KIAA0062 protein | 4.26 | down | 0.00101 |
| M80482 | 2402 | paired basic amino acid cleaving system 4 | 4.26 | down | 0.00041 |
| N73461 | 2672 | EST | 4.25 | down | 0.00162 |
| M68895 | | alcohol dehydrogenase 6 (class V) | 4.25 | down | 0.00354 |
| U48296 | 3368 | protein tyrosine phosphatase type IVA, member 1 | 4.25 | down | 0.02037 |
| AA426330 | 963 | N-acylsphingosine amidohydrolase (acid ceramidase)-like | 4.24 | down | 0.00668 |
| Y10032 | 3855 | serum/glucocorticoid regulated kinase | 4.24 | down | 0.00148 |
| AA456147 | 1188 | general transcription factor IIIA | 4.23 | down | 0.00088 |
| AA456589 | 1194 | EST | 4.23 | down | 0.00102 |
| AA243495 | 528 | lectin, mannose-binding, 1 | 4.23 | down | 0.00179 |
| AA491000 | 1385 | EST | 4.23 | down | 0.02305 |
| AA133296 | 278 | EST | 4.23 | down | 0.00041 |
| AA299632 | 728 | EST | 4.23 | down | 0.00371 |
| T10322 | 3052 | dihydropyrimidinase-like 2 | 4.23 | down | 0.01527 |
| M96233 | 2432 | glutathione S-transferase M1,glutathione S-transferase M2 (muscle),glutathione S-transferase M4 | 4.23 | down | 0.04227 |
| N77606 | 2696 | EST | 4.22 | down | 0.00119 |
| Y10659 | 3856 | interleukin 13 receptor, alpha 1 | 4.22 | down | 0.00061 |
| AA150891 | 331 | EST | 4.22 | down | 0.01692 |
| AA203222 | 424 | FERM, RhoGEF (ARHGEF) and pleckstrin domain protein 1 (chondrocyte-derived) | 4.21 | down | 0.00745 |
| AB002311 | 1535 | PDZ domain containing guanine nucleotide exchange factor(GEF)1; RA(Ras/Rap1A-associating)-GEF | 4.21 | down | 0.00476 |
| AA428607 | 990 | ribosomal protein S5 pseudogene 1 | 4.21 | down | 0.04305 |
| AA417375 | 918 | EST | 4.21 | down | 0.00231 |
| AA504492 | 1414 | tubulin, alpha, ubiquitous | 4.21 | down | 0.00752 |
| N52985 | 2554 | nidogen (enactin) | 4.21 | down | 0.01385 |
| W81268 | 3609 | protein kinase, interferon-inducible double stranded RNA dependent | 4.2 | down | 0.00007 |
| H08054 | 1857 | EST | 4.2 | down | 0.0009 |
| AA193223 | 403 | EST | 4.2 | down | 0.02416 |
| T48980 | 3133 | calmodulin 1 (phosphorylase kinase, delta) | 4.2 | down | 0.0046 |
| X72012 | 3786 | endoglin (Osler-Rendu-Weber syndrome 1) | 4.2 | down | 0.005 |
| M95585 | 2429 | hepatic leukemia factor | 4.2 | down | 0.00212 |
| AA402006 | 834 | EST | 4.19 | down | 0.00094 |
| AA101632 | 217 | EST | 4.19 | down | 0.00023 |
| F10874 | 1823 | EST | 4.19 | down | 0.00025 |
| L00352 | 2131 | low density lipoprotein receptor (familial hypercholesterolemia) | 4.19 | down | 0.00352 |
| S67325 | 3023 | propionyl Coenzyme A carboxylase, beta polypeptide | 4.19 | down | 0.00151 |
| Z39406 | 3902 | nuclear receptor co-repressor 1 | 4.18 | down | 0.00439 |
| D00723 | 1592 | glycine cleavage system protein H (aminomethyl carrier) | 4.18 | down | 0.00543 |
| F13782 | 1827 | LIM binding domain 2 | 4.17 | down | 0.00109 |
| H90417 | 2028 | EST | 4.17 | down | 0.015 |
| W38407 | 3503 | EST | 4.17 | down | 0.00392 |
| AA135558 | 293 | peptidase D | 4.17 | down | 0.0068 |
| D31289 | 1642 | EST | 4.16 | down | 0.02166 |
| W88568 | 3635 | glycogenin 2 | 4.16 | down | 0.00111 |
| AA036662 | 83 | EST | 4.16 | down | 0.00235 |
| AA404500 | 852 | EST | 4.16 | down | 0.01375 |
| R05518 | 2761 | EST | 4.15 | down | 0.0125 |
| H91680 | 2032 | phosphorylase, glycogen; liver (Hers disease, glycogen storage disease type VI) | 4.15 | down | 0.00746 |
| D87075 | 1760 | solute carrier family 23 (nucleobase transporters), member 1 | 4.15 | down | 0.00067 |
| U90545 | 3454 | solute carrier family 17 (sodium phosphate), member 3 | 4.14 | down | 0.00005 |
| H11274 | 1874 | EST | 4.13 | down | 0.01478 |
| AA040087 | 92 | EST | 4.13 | down | 0.00123 |
| R34133 | 2820 | EST | 4.13 | down | 0.00008 |
| AA280130 | 636 | EST | 4.12 | down | 0.00114 |
| T15674 | 3060 | EST | 4.12 | down | 0.02111 |
| M62403 | 2373 | insulin-like growth factor-binding protein 4 | 4.12 | down | 0.00226 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| C01286 | 1555 | integral membrane protein 2B | 4.11 | down | 0.00292 |
| D62103 | 1707 | EST | 4.11 | down | 0.0263 |
| H69565 | 1987 | EST | 4.11 | down | 0.00002 |
| AA190816 | 395 | EST | 4.1 | down | 0.00037 |
| N66422 | 2615 | EST | 4.1 | down | 0.00237 |
| AA417078 | 916 | EST | 4.1 | down | 0.00414 |
| N21079 | 2440 | nucleolar cysteine-rich protein | 4.1 | down | 0.00028 |
| R87373 | 2977 | EST | 4.09 | down | 0.02253 |
| X58022 | 3744 | corticotropin releasing hormone-binding protein | 4.09 | down | 0.00076 |
| AA065173 | 148 | EST | 4.08 | down | 0.00377 |
| AA219653 | 448 | EST | 4.08 | down | 0.00607 |
| M96843 | 2434 | EST | 4.08 | down | 0.02912 |
| AA400251 | 811 | EST | 4.07 | down | 0.00032 |
| N91273 | 2717 | EST | 4.07 | down | 0.02965 |
| AA133439 | 279 | EST | 4.07 | down | 0.00022 |
| AA463729 | 1250 | EST | 4.07 | down | 0.00676 |
| R70790 | 2947 | EST | 4.07 | down | 0.02354 |
| AA279550 | 628 | Kruppel-like factor | 4.06 | down | 0.00957 |
| N36250 | 2505 | cellular repressor of E1A-stimulated genes | 4.06 | down | 0.00776 |
| N48674 | 2529 | EST | 4.06 | down | 0.00028 |
| AA255624 | 571 | EST | 4.06 | down | 0.00069 |
| L09717 | 2153 | lysosomal-associated membrane protein 2 | 4.06 | down | 0.00034 |
| HG2743–HT2845 | | caldesmon 1 | 4.06 | down | 0.00453 |
| AA188921 | 393 | similar to Caenorhabditis elegans protein C42C1.9 | 4.05 | down | 0.004 |
| AA191647 | 399 | ceruloplasmin (ferroxidase) | 4.05 | down | 0.00029 |
| AA084408 | 179 | EST | 4.05 | down | 0.00864 |
| AA418907 | 922 | cytochrome P450, subfamily 1 (aromatic compound-inducible), polypeptide 1 | 4.05 | down | 0.04276 |
| AA608807 | 1471 | inhibin, beta B (activin AB beta polypeptide) | 4.05 | down | 0.00568 |
| AA478416 | 1300 | EST | 4.04 | down | 0.00078 |
| M63967 | 2378 | aldehyde dehydrogenase 5 | 4.04 | down | 0.00058 |
| T68083 | 3184 | short-chain dehydrogenase/reductase 1 | 4.03 | down | 0.01593 |
| AA446666 | 1094 | EST | 4.03 | down | 0.02369 |
| AA465240 | 1270 | EST | 4.03 | down | 0.0046 |
| W46391 | 3524 | alpha integrin binding protein 63 | 4.03 | down | 0.01363 |
| W52821 | 3541 | leucine aminopeptidase | 4.02 | down | 0.03787 |
| AA135958 | 296 | EST | 4.02 | down | 0.00012 |
| AA609774 | 1490 | EST | 4.02 | down | 0.00424 |
| H96614 | 2054 | EST | 4.02 | down | 0.01565 |
| R32036 | 2815 | interleukin 1 receptor-like 1 | 4.02 | down | 0.00051 |
| R61740 | 2922 | EST | 4.02 | down | 0.00321 |
| L17128 | 2167 | gamma-glutamyl carboxylase | 4.02 | down | 0.00096 |
| AA348485 | 757 | KIAA0438 gene product | 4.01 | down | 0.04563 |
| AA151676 | 337 | peptidyl arginine deiminase, type II | 4.01 | down | 0.00911 |
| F04944 | 1795 | acyl-Coenzyme A oxidase | 4.01 | down | 0.00242 |
| D63160 | 1709 | ficolin (collagen/fibrinogen domain-containing lectin) 2 (hucolin) | 4.01 | down | 0.00391 |
| J03242 | 2092 | insulin-like growth factor 2 (somatomedin A) | 4.01 | down | 0.00042 |
| AA255546 | 569 | EST | 4 | down | 0.00301 |
| AA411764 | 891 | similar to APOBEC1 | 4 | down | 0.01491 |
| AA479488 | 1313 | S-adenosylhomocysteine hydrolase-like 1 | 4 | down | 0.0269 |
| R10138 | 2783 | EST | 4 | down | 0.00032 |
| T16478 | 3069 | EST | 4 | down | 0.01041 |
| H71169 | 1992 | putative protein similar to nessy (Drosophila) | 4 | down | 0.00709 |
| X76648 | 3793 | glutaredoxin (thioltransferase) | 4 | down | 0.00211 |
| AA428567 | 989 | EST | 3.99 | down | 0.00788 |
| N22404 | 2449 | EST | 3.99 | down | 0.01152 |
| T90037 | 3245 | EST | 3.99 | down | 0.0016 |
| AA452860 | 1151 | EST | 3.99 | down | 0.00831 |
| H83442 | 2013 | catechol-O-methyltransferase | 3.99 | down | 0.00594 |
| W85888 | 3619 | EST | 3.99 | down | 0.00697 |
| X05409 | 3681 | aldehyde dehydrogenase 2, mitochondrial | 3.99 | down | 0.01029 |
| R00296 | 2749 | EST | 3.98 | down | 0.04632 |
| T69728 | 3198 | heat shock 90kD protein 1, beta | 3.98 | down | 0.00786 |
| AA495820 | 1393 | EST | 3.98 | down | 0.00218 |
| AA400030 | 806 | EST | 3.98 | down | 0.00089 |
| N66130 | 2613 | progesterone membrane binding protein | 3.98 | down | 0.0106 |
| HG2379–HT3997 | | serine hydroxymethyltransferase 1 (soluble) | 3.98 | down | 0.00306 |
| R42241 | 2845 | EST | 3.97 | down | 0.00129 |
| AA449448 | 1125 | EST | 3.97 | down | 0.00103 |
| N53757 | 2559 | EST | 3.97 | down | 0.00255 |
| AA401376 | 829 | EST | 3.97 | down | 0.00797 |
| M29971 | 2320 | O-6-methylguanine-DNA methyltransferase | 3.97 | down | 0.00424 |
| AA281770 | 649 | seven in absentia (Drosophila) homolog 1 | 3.96 | down | 0.00094 |
| AA454184 | 1165 | EST | 3.96 | down | 0.04605 |
| AA255878 | 572 | KIAA0767 protein | 3.96 | down | 0.00592 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| R52800 | 2894 | EST | 3.96 | down | 0.00749 |
| M68840 | 2388 | monoamine oxidase A | 3.96 | down | 0.01396 |
| U16660 | 3312 | enoyl Coenzyme A hydratase 1, peroxisomal | 3.96 | down | 0.00002 |
| AA281677 | 648 | DKFZP564M2423 protein | 3.95 | down | 0.03606 |
| AA495758 | 1391 | EST | 3.94 | down | 0.00772 |
| W36290 | 3500 | Kreisler (mouse) maf-related leucine zipper homolog | 3.94 | down | 0.02718 |
| AA609011 | 1476 | EST | 3.94 | down | 0.0313 |
| T79758 | 3223 | EST | 3.94 | down | 0.00581 |
| W88985 | 3637 | KIAA0903 protein | 3.94 | down | 0.00295 |
| AA157112 | 345 | EST | 3.94 | down | 0.02571 |
| AA398422 | 794 | EST | 3.94 | down | 0.00388 |
| U78190 | 3430 | GTP cyclohydrolase 1 feedback regulatory protein | 3.94 | down | 0.034 |
| R98774 | 3013 | EST | 3.93 | down | 0.00001 |
| AA435824 | 1048 | EST | 3.93 | down | 0.02764 |
| AA609996 | 1495 | EST | 3.93 | down | 0.00988 |
| M55150 | 2352 | fumarylacetoacetate | 3.93 | down | 0.00213 |
| U50527 | 3377 | EST | 3.93 | down | 0.00123 |
| H11746 | 1877 | EST | 3.92 | down | 0.00012 |
| L09708 | 2152 | complement component 2 | 3.92 | down | 0.00693 |
| U20938 | 3323 | dihydropyrimidine dehydrogenase | 3.92 | down | 0.00053 |
| W63785 | 3564 | EST | 3.91 | down | 0.04089 |
| R31917 | 2814 | EST | 3.91 | down | 0.00071 |
| R96417 | 2997 | EST | 3.9 | down | 0.00019 |
| F02245 | 1776 | monoamine oxidase A | 3.9 | down | 0.02943 |
| F02345 | 1779 | EST | 3.9 | down | 0.0033 |
| AA252365 | 554 | EST | 3.9 | down | 0.01796 |
| C14963 | 1572 | nicotinamide nucleotide transhydrogenase | 3.9 | down | 0.0044 |
| T24055 | 3086 | ribosomal protein L26 | 3.9 | down | 0.00046 |
| AA599234 | 1447 | murine leukemia viral (bmi-1) oncogene homolog | 3.9 | down | 0.0068 |
| AA253043 | 559 | DKFZP586I1419 protein, | 3.89 | down | 0.00145 |
| Z40192 | 3915 | EST | 3.89 | down | 0.00223 |
| AA342301 | 746 | EST | 3.89 | down | 0.00038 |
| AA608729 | 1468 | EST | 3.89 | down | 0.01757 |
| AA234561 | 485 | EST | 3.88 | down | 0.02058 |
| H65650 | 1976 | EST | 3.88 | down | 0.0083 |
| N68730 | 2636 | EST | 3.88 | down | 0.00091 |
| T90492 | 3247 | EST | 3.88 | down | 0.00454 |
| M10943 | 2234 | metallothionein 1F (functional) | 3.88 | down | 0 |
| T68510 | 3186 | EST | 3.87 | down | 0.00617 |
| AA448282 | 1115 | EST | 3.87 | down | 0.00217 |
| H18997 | 1893 | F-box protein 21 | 3.87 | down | 0.00611 |
| AA251837 | 547 | EST | 3.87 | down | 0.00782 |
| AA342337 | 747 | EST | 3.87 | down | 0.0069 |
| L22548 | 2178 | collagen, type XVIII, alpha 1 | 3.87 | down | 0.0299 |
| J03805 | 2098 | protein phosphatase 2 (formerly 2A), catalytic subunit, beta isoform | 3.87 | down | 0.0116 |
| H87765 | 2017 | KIAA0626 gene product | 3.86 | down | 0.00131 |
| W94427 | 3656 | EST | 3.86 | down | 0.02649 |
| H97868 | 2064 | EST | 3.86 | down | 0.00362 |
| H97986 | 2065 | EST | 3.86 | down | 0.01534 |
| H18950 | 1892 | EST | 3.85 | down | 0.00162 |
| T10108 | 3049 | EST | 3.85 | down | 0.01155 |
| AA447977 | 1111 | EST | 3.84 | down | 0.00045 |
| T10264 | 3050 | EST | 3.84 | down | 0.00874 |
| Z11737 | 3860 | flavin containing monooxygenase 4 | 3.84 | down | 0.00043 |
| U49785 | 3375 | D-dopachrome tautomerase | 3.84 | down | 0.00044 |
| M30185 | 2321 | cholesteryl ester transfer protein, plasma | 3.83 | down | 0.0013 |
| W85765 | 3615 | EST | 3.83 | down | 0.00379 |
| D80218 | 1728 | brain acid-soluble protein 1 | 3.83 | down | 0.0137 |
| H68097 | 1982 | EST | 3.83 | down | 0.00797 |
| N49104 | 2533 | nuclear receptor interacting protein 1 | 3.83 | down | 0.00144 |
| D16350 | 1620 | SA (rat hypertension-associated) homolog | 3.83 | down | 0.00117 |
| Z31690 | 3878 | lipase A, lysosomal acid, cholesterol esterase (Wolman disease) | 3.83 | down | 0.00103 |
| AA056170 | 137 | EST | 3.82 | down | 0.0083 |
| AA093923 | 200 | EST | 3.82 | down | 0.03924 |
| U50196 | 3376 | adenosine kinase | 3.82 | down | 0.01425 |
| W20276 | 3477 | EST | 3.82 | down | 0.00033 |
| T82254 | 3228 | EST | 3.82 | down | 0.00091 |
| D45529 | 1662 | EST | 3.82 | down | 0.00193 |
| AA043501 | 98 | v-maf musculoaponeurotic fibrosarcoma (avian) oncogene homolog | 3.81 | down | 0.01304 |
| AA376875 | 770 | monoamine oxidase A | 3.8 | down | 0.02746 |
| AA430108 | 1013 | EST | 3.8 | down | 0.04484 |
| AA598746 | 1437 | EST | 3.8 | down | 0.02667 |
| AA046840 | 115 | CCAAT/enhancer binding protein (C/EBP), delta | 3.79 | down | 0.3319 |
| N21646 | 2445 | EST | 3.79 | down | 0.00079 |
| N66763 | 2618 | EST | 3.79 | down | 0.03015 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| R97798 | 3006 | EST | 3.79 | down | 0.00015 |
| U73514 | 3418 | hydroxyacyl-Coenzyme A dehydrogenase, type II | 3.79 | down | 0.01392 |
| HG2090–HT2152 | | CD163 antigen | 3.79 | down | 0.01078 |
| W45259 | 3519 | EST | 3.78 | down | 0.00069 |
| AA398221 | 790 | calcium/calmodulin-dependent protein kinase (CaM kinase) II beta | 3.78 | down | 0.00019 |
| AA449297 | 1121 | EST | 3.78 | down | 0.00039 |
| AA076249 | 169 | EST | 3.78 | down | 0.00029 |
| AA262349 | 607 | EST | 3.78 | down | 0.00043 |
| X75252 | 3790 | prostatic binding protein | 3.78 | down | 0.00231 |
| AA393961 | 777 | EST | 3.77 | down | 0.01029 |
| W86756 | 3627 | retinoid X receptor, alpha | 3.77 | down | 0.02472 |
| J03507 | 2095 | complement component 7 | 3.77 | down | 0.00184 |
| X52541 | 3721 | early growth response 1 | 3.77 | down | 0.00894 |
| N23817 | 2457 | EST | 3.76 | down | 0.00288 |
| T74884 | 3216 | EST | 3.76 | down | 0.0547 |
| X77548 | 3795 | nuclear receptor coactivator 4 | 3.76 | down | 0.00758 |
| F03200 | 1783 | EST | 3.75 | down | 0.01805 |
| R22196 | 2798 | EST | 3.75 | down | 0.02867 |
| R02371 | 2755 | EST | 3.75 | down | 0.00009 |
| M86826 | 2412 | insulin-like growth factor binding protein, acid labile subunit | 3.75 | down | 0.01157 |
| HG4322–HT4592 | | tubulin, beta polypeptide | 3.75 | down | 0.00554 |
| AA059489 | 145 | RGC32 protein | 3.74 | down | 0.00734 |
| AA010530 | 25 | EST | 3.74 | down | 0.0481 |
| D80312 | 1730 | EST | 3.74 | down | 0.01909 |
| AA426168 | 960 | KIAA0805 protein | 3.73 | down | 0.01477 |
| H51340 | 1941 | EST | 3.73 | down | 0.02643 |
| AA455367 | 1176 | DKFZP586F1018 protein | 3.73 | down | 0.00202 |
| AA481526 | 1329 | EST | 3.73 | down | 0.00002 |
| AA491001 | 1386 | EST | 3.73 | down | 0.01957 |
| D60670 | 1702 | EST | 3.73 | down | 0.00382 |
| N75072 | 2688 | EST | 3.73 | down | 0.00379 |
| R97302 | 3002 | EST | 3.73 | down | 0.01887 |
| AA410507 | 884 | EST | 3.73 | down | 0.01703 |
| W46404 | 3525 | EST | 3.73 | down | 0.00116 |
| AA459389 | 1216 | tyrosylprotein sulfotransferase 2 | 3.72 | down | 0.02252 |
| H16768 | 1887 | EST | 3.72 | down | 0.00688 |
| N54604 | 2569 | EST | 3.72 | down | 0.00741 |
| N62443 | 2589 | EST | 3.72 | down | 0.01717 |
| H49415 | 1938 | EST | 3.72 | down | 0.0005 |
| N40188 | 2512 | EST | 3.72 | down | 0.01771 |
| R05309 | 2758 | EST | 3.72 | down | 0.0008 |
| AA428006 | 984 | DKFZP564B167 protein | 3.71 | down | 0.02325 |
| AA463311 | 1248 | EST | 3.71 | down | 0.04902 |
| N30856 | 2484 | solute carrier family 19 (thiamine transporter), member 2 | 3.71 | down | 0.00393 |
| S62539 | 3021 | insulin receptor substrate 1 | 3.7 | down | 0.01307 |
| AA179387 | 379 | DKFZP434N126 protein | 3.7 | down | 0.01588 |
| AA235288 | 494 | PTPL1-associated RhoGAP 1 | 3.7 | down | 0.00643 |
| AA598926 | 1441 | EST | 3.7 | down | 0.00432 |
| AA099589 | 210 | GDP dissociation inhibitor 2 | 3.7 | down | 0.04069 |
| AA382975 | 773 | EST | 3.7 | down | 0.00131 |
| L15702 | 2165 | B-factor, properdin | 3.7 | down | 0.04693 |
| D13705 | 1610 | cytochrome P450, subfamily IVA, polypeptide 11 | 3.7 | down | 0.00038 |
| X14787 | 3701 | thrombospondin 1 | 3.69 | down | 0.01115 |
| AA125861 | 243 | EST | 3.69 | down | 0.01547 |
| AA460916 | 1233 | EST | 3.69 | down | 0.04841 |
| AA156336 | 341 | nuclear receptor co-repressor 1 | 3.69 | down | 0.01276 |
| H41280 | 1925 | EST | 3.68 | down | 0.00455 |
| R00843 | 2750 | fragile histidine triad gene | 3.68 | down | 0.03578 |
| Z39431 | 3904 | KIAA1086 protein | 3.68 | down | 0.0013 |
| AA426156 | 959 | EST | 3.67 | down | 0.00153 |
| Z11737 | 3860 | flavin containing monooxygenase 4 | 3.67 | down | 0.00632 |
| AA283758 | 670 | EST | 3.67 | down | 0.04293 |
| H66840 | 1978 | EST | 3.67 | down | 0.0143 |
| W87824 | 3634 | EST | 3.67 | down | 0.01559 |
| AA287122 | 686 | EST | 3.66 | down | 0.00161 |
| L76927 | 2228 | galactokinase 1 | 3.66 | down | 0.00999 |
| AA031548 | 69 | cell division cycle 42 (GTP-binding protein, 25kD) | 3.65 | down | 0.03029 |
| AA400259 | 813 | EST | 3.65 | down | 0.00476 |
| H25124 | 1903 | EST | 3.65 | down | 0.00004 |
| AA279802 | 631 | EST | 3.65 | down | 0.03366 |
| U27699 | 3339 | solute carrier family 6 (neurotransmitter transporter, betaine/GABA), member 12 | 3.65 | down | 0.00381 |
| C02460 | 1562 | EST | 3.64 | down | 0.02705 |
| Z29481 | 3874 | 3-hydroxyanthranilate 3,4-dioxygenase | 3.64 | down | 0.00096 |
| AA281545 | 645 | EST | 3.64 | down | 0.00002 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA235811 | 502 | EST | 3.64 | down | 0.01272 |
| D86062 | 1752 | ES1 (zebrafish) protein, human homolog of | 3.63 | down | 0.0001 |
| Z41042 | 3925 | EST | 3.63 | down | 0.00943 |
| N69299 | 2648 | EST | 3.63 | down | 0.03776 |
| AA044622 | 103 | EST | 3.62 | down | 0.03789 |
| AA393825 | 776 | EST | 3.62 | down | 0.0065 |
| D80217 | 1727 | H91620p protein | 3.61 | down | 0.01973 |
| N45232 | 2516 | EST | 3.61 | down | 0.01308 |
| U48959 | 3371 | myosin, light polypeptide kinase | 3.61 | down | 0.00084 |
| F09058 | 1799 | EST | 3.6 | down | 0.00595 |
| T90531 | 3249 | EST | 3.6 | down | 0.00301 |
| AA025930 | 52 | EST | 3.59 | down | 0.00372 |
| AA235765 | 501 | KIAA0214 gene product | 3.59 | down | 0.01148 |
| D80905 | 1735 | EST | 3.59 | down | 0.0007 |
| H99935 | 2085 | interleukin 6 signal transducer (gp130, oncostatin M receptor) | 3.59 | down | 0.00366 |
| AA242766 | 523 | EST | 3.58 | down | 0.0151 |
| AA441791 | 1065 | EST | 3.58 | down | 0.00357 |
| F10640 | 1821 | EST | 3.58 | down | 0.00152 |
| AA282886 | 663 | EST | 3.57 | down | 0.00049 |
| AA416723 | 906 | EST | 3.57 | down | 0.01042 |
| H98977 | 2073 | EST | 3.57 | down | 0.00298 |
| T33011 | 3103 | EST | 3.57 | down | 0.02486 |
| T41232 | 3121 | EST | 3.57 | down | 0.00846 |
| T91348 | 3253 | EST | 3.57 | down | 0.00011 |
| AA427778 | 978 | EST | 3.57 | down | 0.00368 |
| H04142 | 1836 | EST | 3.57 | down | 0.01906 |
| R40556 | 2842 | EST | 3.57 | down | 0.00184 |
| AA032250 | 73 | EST | 3.56 | down | 0.0009 |
| R21232 | 2797 | EST | 3.56 | down | 0.00246 |
| AA127444 | 252 | EST | 3.56 | down | 0.0291 |
| H40424 | 1922 | butyrate response factor 1 (EGF-response factor 1) | 3.56 | down | 0.04066 |
| W15528 | 3474 | EST | 3.56 | down | 0.00424 |
| Z39978 | 3913 | EST | 3.56 | down | 0.04051 |
| L76465 | 2224 | hydroxyprostaglandin dehydrogenase 15-(NAD) | 3.56 | down | 0.00688 |
| HG3417–HT3600 | | GTP cyclohydrolase 1 (dopa-responsive dystonia) | 3.56 | down | 0.00317 |
| R71491 | 2953 | EST | 3.55 | down | 0.01903 |
| AA040291 | 94 | KIAA0669 gene product | 3.55 | down | 0.00308 |
| N49902 | 2539 | EST | 3.55 | down | 0.00455 |
| N67009 | 2621 | prion protein (p27–30) (Creutzfeld-Jakob disease, Gerstmann-Strausler-Scheinker syndrome, fatal familial insomnia) | 3.55 | down | 0.00956 |
| H25551 | 1904 | EST | 3.54 | down | 0.00366 |
| R51309 | 2889 | KIAA1077 protein | 3.54 | down | 0.04112 |
| AA039806 | 91 | msh (Drosophila) homeo box homolog 1 (formerly homeo box 7) | 3.53 | down | 0.00114 |
| AA194146 | 407 | EST | 3.53 | down | 0.00352 |
| AA037357 | 85 | EST | 3.53 | down | 0.02129 |
| AA287550 | 689 | DKFZP434C171 protein | 3.53 | down | 0.00217 |
| AA094507 | 201 | EST | 3.52 | down | 0.04783 |
| AA496423 | 1399 | WW domain binding protein 2 | 3.52 | down | 0.01314 |
| AA421052 | 929 | branched chain alpha-ketoacid dehydrogenase kinase | 3.52 | down | 0.00869 |
| X94563 | 3828 | EST | 3.52 | down | 0.00928 |
| W07723 | 3470 | EST | 3.51 | down | 0.00026 |
| X52150 | 3719 | arylsulfatase A | 3.51 | down | 0.00113 |
| AA055992 | 136 | calumenin | 3.51 | down | 0.00604 |
| N64436 | 2608 | EST | 3.51 | down | 0.00441 |
| R26904 | 2804 | EST | 3.51 | down | 0.00058 |
| L29008 | 2189 | sorbitol dehydrogenase | 3.51 | down | 0.00825 |
| U79716 | 3436 | reelin | 3.51 | down | 0.00053 |
| AA435591 | 1038 | kinesin family member 3B | 3.5 | down | 0.0001 |
| R12579 | 2789 | EST | 3.5 | down | 0.00137 |
| AA428863 | 991 | EST | 3.5 | down | 0.01726 |
| AA400780 | 818 | EST | 3.5 | down | 0.00107 |
| U44111 | 3362 | histamine N-methyltransferase | 3.5 | down | 0.00942 |
| U46689 | 3365 | aldehyde dehydrogenase 10 (fatty aldehyde dehydrogenase) | 3.5 | down | 0.01292 |
| Y08374 | 3850 | chitinase 3-like 1 (cartilage glycoprotein-39) | 3.5 | down | 0.04208 |
| H42053 | 1927 | EST | 3.49 | down | 0.01057 |
| AA489061 | 1367 | EST | 3.49 | down | 0.00223 |
| AA400831 | 819 | EST | 3.49 | down | 0.00105 |
| L07033 | 2144 | 3-hydroxymethyl-3-methylglutaryl-Coenzyme A lyase (hydroxymethylglutaricaciduria) | 3.49 | down | 0 |
| AA056247 | 138 | EST | 3.48 | down | 0.03277 |
| AA496914 | 1401 | v-maf musculoaponeurotic fibrosarcoma (avian) oncogene homolog | 3.48 | down | 0.00361 |
| H13696 | 1882 | EST | 3.48 | down | 0.01796 |
| F08941 | 1798 | EST | 3.48 | down | 0.00428 |
| T91161 | 3252 | EST | 3.48 | down | 0.00002 |
| M60974 | 2368 | growth arrest and DNA-damage-inducible, alpha | 3.48 | down | 0.00209 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| AA069456 | 149 | KIAA0438 gene product | 3.47 | down | 0.02718 |
| AA218727 | 445 | EST | 3.47 | down | 0.00125 |
| H02848 | 1831 | TEK tyrosine kinase, endothelial (venous malformations, multiple cutaneous and mucosal) | 3.47 | down | 0.0089 |
| AA282238 | 656 | EST | 3.47 | down | 0.00677 |
| AA092596 | 197 | bone morphogenetic protein 6 | 3.46 | down | 0.02532 |
| U84569 | 3444 | chromosome 21 open reading frame 2 | 3.46 | down | 0.01844 |
| R52949 | 2896 | EST | 3.46 | down | 0.00395 |
| W85886 | 3618 | EST | 3.46 | down | 0.00814 |
| AA455896 | 1181 | glypican 1 | 3.46 | down | 0.00887 |
| N93155 | 2728 | calmodulin 1 (phosphorylase kinase, delta) | 3.46 | down | 0.00031 |
| N59231 | 2581 | pyruvate carboxylase | 3.45 | down | 0.02066 |
| W73194 | 3587 | dermatopontin | 3.45 | down | 0.02211 |
| N54511 | 2568 | KIAA0265 protein | 3.45 | down | 0.03362 |
| M14636 | 2262 | phosphorylase, glycogen; liver (Hers disease, glycogen storage disease type VI) | 3.45 | down | 0.00133 |
| M18533 | 2284 | dystrophin (muscular dystrophy, Duchenne and Becker types), includes DXS142, DXS164, DXS206, DXS230, DXS239, DXS268, DXS269, DXS270, DXS272 | 3.45 | down | 0.00313 |
| M81182 | 2403 | ATP-binding cassette, sub-family D (ALD), member 3 | 3.45 | down | 0.00499 |
| M23161 | 2298 | EST | 3.44 | down | 0.00733 |
| AA427819 | 980 | midline 2 | 3.44 | down | 0.00063 |
| AA430047 | 1011 | EST | 3.44 | down | 0.0016 |
| AA621235 | 1517 | EST | 3.44 | down | 0.0021 |
| AA451911 | 1139 | EST | 3.44 | down | 0.00221 |
| H89514 | 2023 | protein kinase, cAMP-dependent, catalytic, alpha | 3.44 | down | 0.00435 |
| AA017192 | 37 | EST | 3.43 | down | 0.04865 |
| AA235618 | 499 | EST | 3.43 | down | 0.02127 |
| H99393 | 2076 | endothelin receptor type B | 3.43 | down | 0.00093 |
| AF005039 | 1548 | secretory carrier membrane protein 3 | 3.42 | down | 0.04953 |
| AA234831 | 491 | EST | 3.42 | down | 0.00206 |
| AA620830 | 1509 | DKFZP564I122 protein | 3.42 | down | 0.02421 |
| N70005 | 2652 | EST | 3.42 | down | 0.04229 |
| T96969 | 3263 | EST | 3.42 | down | 0.00053 |
| AA279112 | 622 | EST | 3.42 | down | 0.01444 |
| H82966 | 2011 | apolipoprotein B (including Ag(x) antigen) | 3.42 | down | 0.00769 |
| AA505198 | 1419 | EST | 3.41 | down | 0.0343 |
| AA429478 | 998 | EST | 3.41 | down | 0.02599 |
| AA463195 | 1245 | EST | 3.41 | down | 0.00413 |
| AA476352 | 1284 | EST | 3.41 | down | 0.02233 |
| F02094 | 1775 | ecotropic viral integration site 5 | 3.41 | down | 0.00495 |
| H87144 | 2016 | EST | 3.41 | down | 0.00387 |
| U86529 | 3450 | glutathione S-transferase zeta 1 (maleylacetoacetate isomerase) | 3.41 | down | 0.0118 |
| N49113 | 2534 | EST | 3.4 | down | 0.00162 |
| AA127514 | 253 | EST | 3.4 | down | 0.00045 |
| N69216 | 2645 | EST | 3.4 | down | 0.00497 |
| J04031 | 2103 | methylenetetrahydrofolate dehydrogenase (NADP+ dependent), methenyltetrahydrofolate cyclohydrolase, formyltetrahydrofolate synthetase | 3.4 | down | 0.00786 |
| L49169 | 2221 | FBJ murine osteosarcoma viral oncogene homolog B | 3.4 | down | 0.01193 |
| M30269 | 2323 | nidogen (enactin) | 3.4 | down | 0.00026 |
| U21931 | 3325 | fructose-bisphosphatase 1 | 3.4 | down | 0.00709 |
| Y00097 | 3841 | annexin A6 | 3.4 | down | 0.00233 |
| AA047290 | 118 | EST | 3.39 | down | 0.00024 |
| AA250744 | 536 | EST | 3.39 | down | 0.01137 |
| H26763 | 1907 | EST | 3.39 | down | 0.04188 |
| M30185 | 2321 | cholesteryl ester transfer protein, plasma | 3.39 | down | 0.00089 |
| M25280 | 2306 | selectin L (lymphocyte adhesion molecule 1) | 3.39 | down | 0.004 |
| AA463946 | 1254 | pigment epithelium-derived factor | 3.38 | down | 0.0018 |
| AA279937 | 634 | EST | 3.38 | down | 0.02719 |
| AA426468 | 966 | EST | 3.38 | down | 0.0099 |
| J04621 | 2113 | syndecan 2 (heparan sulfate proteoglycan 1, cell surface-associated, fibroglycan) | 3.38 | down | 0.00275 |
| AA461458 | 1241 | EST | 3.37 | down | 0.02427 |
| R17762 | 2794 | EST | 3.37 | down | 0.01822 |
| R43166 | 2846 | EST | 3.37 | down | 0.00919 |
| R97711 | 3004 | EST | 3.37 | down | 0.00838 |
| AA112209 | 223 | acyl-Coenzyme A dehydrogenase, long chain | 3.37 | down | 0.00084 |
| M88163 | 2415 | SWI/SNF related, matrix associated, actin dependent regulator of chromatin, subfamily a, member 1 | 3.37 | down | 0.00098 |
| U02020 | 3276 | pre-B-cell colony-enhancing factor | 3.37 | down | 0.01112 |
| N48180 | 2525 | EST | 3.36 | down | 0.00543 |
| T16269 | 3066 | EST | 3.36 | down | 0.00282 |
| AA134549 | 288 | EST | 3.36 | down | 0.03438 |
| AA458923 | 1207 | EST | 3.36 | down | 0.00421 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| D80408 | 1731 | EST | 3.36 | down | 0.00102 |
| AA293485 | 718 | EST | 3.36 | down | 0.02799 |
| W31478 | 3495 | EST | 3.36 | down | 0.01511 |
| M59916 | 2365 | sphingomyelin phosphodiesterase 1, acid lysosomal (acid sphingomyelinase) | 3.36 | down | 0.0038 |
| M23263 | 2300 | androgen receptor (dihydrotestosterone receptor; testicular feminization; spinal and bulbar muscular atrophy; Kennedy disease) | 3.35 | down | 0.02551 |
| H83451 | 2014 | EST | 3.35 | down | 0.00498 |
| W90560 | 3644 | EST | 3.35 | down | 0.00388 |
| AA456326 | 1191 | EST | 3.35 | down | 0.00489 |
| Z38192 | 3882 | EST | 3.35 | down | 0.00184 |
| AA284721 | 677 | EST | 3.34 | down | 0.03296 |
| D59344 | 1695 | EST | 3.34 | down | 0.01337 |
| N47469 | 2521 | EST | 3.34 | down | 0.00329 |
| N22854 | 2451 | CASP2 and RIPK1 domain containing adaptor with death domain | 3.34 | down | 0.0084 |
| N54399 | 2565 | EST | 3.34 | down | 0.00048 |
| U82468 | 3441 | tubby like protein 1 | 3.34 | down | 0.0097 |
| AA460047 | 1226 | EST | 3.33 | down | 0.04011 |
| AA001604 | 4 | EST | 3.33 | down | 0.0215 |
| AA121140 | 235 | EST | 3.33 | down | 0.00058 |
| HG2743–HT2846 | | caldesmon 1 | 3.33 | down | 0.00135 |
| N51737 | 2546 | mitogen-activated protein kinase kinase kinase 12 | 3.32 | down | 0.00376 |
| AA430026 | 1007 | EST | 3.31 | down | 0.00786 |
| H06166 | 1854 | EST | 3.31 | down | 0.03778 |
| AA062744 | 147 | EST | 3.31 | down | 0.01909 |
| W81079 | 3608 | EST | 3.31 | down | 0.0167 |
| AA227480 | 456 | pim-2 oncogene | 3.31 | down | 0.02413 |
| AA463876 | 1252 | EST | 3.31 | down | 0.00109 |
| H09167 | 1860 | KIAA0195 gene product | 3.31 | down | 0.00313 |
| H98822 | 2070 | EST | 3.31 | down | 0.00174 |
| R92458 | 2985 | hemoglobin, gamma G | 3.31 | down | 0.00763 |
| AA453917 | 1159 | EST | 3.3 | down | 0.01896 |
| M61854 | 2370 | cytochrome P450, subfamily IIC (mephenytoin 4-hydroxylase) | 3.3 | down | 0.04185 |
| AA281796 | 650 | mannose-P-dolichol utilitzation defect 1 | 3.3 | down | 0.04108 |
| F09353 | 1802 | solute carrier family 5 (inositol transporters), member 3 | 3.3 | down | 0.02841 |
| N27563 | 2472 | EST | 3.3 | down | 0.00021 |
| R01081 | 2752 | EST | 3.3 | down | 0.00839 |
| H25836 | 1905 | tumor necrosis factor (ligand) superfamily, member 10 | 3.3 | down | 0.03125 |
| AA452549 | 1146 | platelet-derived growth factor receptor, alpha polypeptide | 3.3 | down | 0.04155 |
| U28833 | 3340 | Down syndrome candidate region 1 | 3.3 | down | 0.00306 |
| T23680 | 3083 | calcium channel, voltage-dependent, gamma subunit 3 | 3.29 | down | 0.0003 |
| AA429038 | 995 | EST | 3.29 | down | 0.00927 |
| AA490882 | 1381 | EST | 3.29 | down | 0.00319 |
| AA460128 | 1227 | similar to S. pombe dim1+ | 3.28 | down | 0.01299 |
| AA496053 | 1396 | EST | 3.28 | down | 0.00095 |
| T52564 | 3140 | EST | 3.28 | down | 0.01506 |
| T55547 | 3147 | EST | 3.28 | down | 0.00047 |
| Z38777 | 3892 | nuclear receptor binding factor-2 | 3.28 | down | 0.022 |
| AA235507 | 498 | golgi autoantigen, golgin subfamily a, 5 | 3.28 | down | 0.00249 |
| X83416 | 3808 | prion protein (p27–30) (Creutzfeld-Jakob disease, Gerstmann-Strausler-Scheinker syndrome, fatal familial insomnia) | 3.28 | down | 0.00221 |
| H04242 | 1837 | RAB5B, member RAS oncogene family | 3.27 | down | 0.04826 |
| N52322 | 2552 | EST | 3.27 | down | 0.00933 |
| H63251 | 1972 | KIAA0606 protein; SCN Circadian Oscillatory Protein (SCOP) | 3.27 | down | 0.02455 |
| AA281930 | 651 | core-binding factor, runt domain, alpha subunit 2; translocated to, 3 | 3.27 | down | 0.02329 |
| X02160 | 3668 | insulin receptor | 3.27 | down | 0.0007 |
| C15871 | 1575 | EST | 3.26 | down | 0.00046 |
| AA447617 | 1103 | EST | 3.26 | down | 0.04687 |
| AA464603 | 1260 | EST | 3.26 | down | 0.0007 |
| Z39818 | 3909 | EST | 3.26 | down | 0.00089 |
| Z84718 | 3949 | EST | 3.26 | down | 0.02252 |
| AA598675 | 1433 | EST | 3.25 | down | 0.03934 |
| N93191 | 2729 | EST | 3.25 | down | 0.00232 |
| H09959 | 1869 | choline kinase | 3.25 | down | 0.00225 |
| H79820 | 2004 | EST | 3.25 | down | 0.01466 |
| AA070090 | 152 | EST | 3.24 | down | 0.00804 |
| AA406435 | 877 | EST | 3.24 | down | 0.00941 |
| W60186 | 3554 | EST | 3.24 | down | 0.00228 |
| H67094 | 1979 | EST | 3.24 | down | 0.00075 |
| R39234 | 2834 | EST | 3.24 | down | 0.0412 |
| T54160 | 3144 | EST | 3.24 | down | 0.00168 |
| T72629 | 3208 | EST | 3.24 | down | 0.00556 |
| W87480 | 3630 | STAT induced STAT inhibitor-2 | 3.24 | down | 0.01063 |
| Z14093 | 3862 | branched chain keto acid dehydrogenase E1, alpha polypeptide (maple syrup urine disease) | 3.24 | down | 0.00301 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| N54792 | 2570 | cytidine monophosphate-N-acetylneuraminic acid hydroxylase (CMP-N-acetylneuraminate monooxygenase) | 3.23 | down | 0.0099 |
| AA076238 | 168 | EST | 3.23 | down | 0.00395 |
| AA088698 | 188 | EST | 3.23 | down | 0.02543 |
| AA281591 | 646 | EST | 3.23 | down | 0.00895 |
| N67096 | 2622 | EST | 3.23 | down | 0.00446 |
| U51903 | 3386 | IQ motif containing GTPase activating protein 2 | 3.23 | down | 0.00242 |
| AA436880 | 1058 | EST | 3.22 | down | 0.00699 |
| H26417 | 1906 | EST | 3.22 | down | 0.03672 |
| N53352 | 2557 | EST | 3.22 | down | 0.00416 |
| AA447740 | 1106 | EST | 3.22 | down | 0.02518 |
| HG3510–HT3704 | | nuclear receptor subfamily 2, group F, member 1 | 3.22 | down | 0.00034 |
| HG3431–HT3616 | | decorin | 3.22 | down | 0.01941 |
| AA443993 | 1086 | EST | 3.21 | down | 0.02948 |
| T65972 | 3176 | EST | 3.21 | down | 0.04847 |
| S52028 | 3018 | cystathionase (cystathionine gamma-lyase) | 3.21 | down | 0.00476 |
| M33318 | 2339 | cytochrome P450, subfamily IIA (phenobarbital-inducible), polypeptide 6 | 3.21 | down | 0.01621 |
| AA348466 | 756 | regulator of G-protein signalling 5 | 3.2 | down | 0.00571 |
| AA459293 | 1213 | EST | 3.2 | down | 0.0001 |
| H27330 | 1909 | EST | 3.2 | down | 0.00067 |
| AA046457 | 111 | EST | 3.2 | down | 0.00513 |
| AA234916 | 492 | EST | 3.2 | down | 0.00799 |
| R10662 | 2786 | mutL (E. coli) homolog 1 (colon cancer, nonpolyposis type 2) | 3.2 | down | 0.0005 |
| H46990 | 1933 | cytochrome P450, subfamily IIE (ethanol-inducible) | 3.2 | down | 0.00095 |
| U01824 | 3275 | solute carrier family 1 (glial high affinity gluamate transporter), member 2 | 3.2 | down | 0.00021 |
| X61123 | 3750 | B-cell translocation gene 1, anti-proliferative | 3.2 | down | 0.00796 |
| H10482 | 1870 | EST | 3.19 | down | 0.01611 |
| U82108 | 3440 | solute carrier family 9 (sodium/hydrogen exchanger), isoform 3 regulatory factor 2 | 3.19 | down | 0.01545 |
| AA084668 | 180 | ubiquitin-like 3 | 3.19 | down | 0.0419 |
| H12257 | 1879 | EST | 3.19 | down | 0.0069 |
| N74558 | 2686 | EST | 3.19 | down | 0.00247 |
| R69031 | 2940 | EST | 3.19 | down | 0.00798 |
| AA191488 | 398 | solute carrier family 31 (copper transporters), member 1 | 3.19 | down | 0.00013 |
| U67963 | 3409 | lysophospholipase-like | 3.19 | down | 0.00029 |
| M24283 | 2303 | intercellular adhesion molecule 1 (CD54), human rhinovirus receptor | 3.19 | down | 0.04985 |
| AA157520 | 347 | EST | 3.18 | down | 0.00516 |
| AA418098 | 920 | cAMP responsive element binding protein-like 2 | 3.18 | down | 0.03824 |
| AA005202 | 12 | retinol-binding protein 4, interstitial | 3.18 | down | 0.00106 |
| AA227901 | 459 | SEC24 (S. cerevisiae) related gene family, member B | 3.18 | down | 0.00397 |
| H40534 | 1923 | EST | 3.18 | down | 0.01381 |
| AA236942 | 519 | EST | 3.18 | down | 0 |
| D16481 | 1621 | hydroxyacyl-Coenzyme A dehydrogenase/3-ketoacyl-Coenzyme A thiolase/enoyl-Coenzyme A hydratase (trifunctional protein), beta subunit | 3.18 | down | 0.00695 |
| D31225 | 1641 | EST | 3.17 | down | 0.01073 |
| H95358 | 2049 | EST | 3.17 | down | 0.00182 |
| H89893 | 2025 | EST | 3.17 | down | 0.00658 |
| N48602 | 2528 | EST | 3.17 | down | 0.02913 |
| T86464 | 3236 | EST | 3.17 | down | 0.00498 |
| AA125856 | 242 | EST | 3.17 | down | 0.01545 |
| H93562 | 2038 | proline synthetase co-transcribed (bacterial homolog) | 3.17 | down | 0.00113 |
| Y10659 | 3856 | interleukin 13 receptor, alpha 1 | 3.17 | down | 0.00095 |
| X67235 | 3770 | hematopoietically expressed homeobox | 3.17 | down | 0.0045 |
| AA004231 | 7 | EST | 3.16 | down | 0.03067 |
| F04335 | 1787 | EST | 3.16 | down | 0.0058 |
| T10822 | 3054 | EST | 3.16 | down | 0.00635 |
| T79842 | 3224 | EST | 3.16 | down | 0.03159 |
| AA180356 | 382 | EST | 3.16 | down | 0.00917 |
| AA207123 | 430 | immunoglobulin superfamily, member 3 | 3.16 | down | 0.00328 |
| AA397914 | 783 | EST | 3.16 | down | 0.00336 |
| AA599954 | 1459 | cell cycle progression 8 protein | 3.15 | down | 0.00021 |
| H06063 | 1852 | chondroitin sulfate proteoglycan 3 (neurocan) | 3.15 | down | 0.00599 |
| W61000 | 3557 | EST | 3.15 | down | 0.03143 |
| J02888 | 2089 | NAD(P)H menadione oxidoreductase 2, dioxin-inducible | 3.15 | down | 0.02385 |
| U62389 | 3401 | isocitrate dehydrogenase 1 (NADP+), soluble | 3.15 | down | 0.03949 |
| X04729 | 3679 | plasminogen activator inhibitor, type 1 | 3.15 | down | 0.01337 |
| N45998 | 2519 | EST | 3.14 | down | 0.00337 |
| R54416 | 2900 | EST | 3.14 | down | 0.00236 |
| AA446651 | 1093 | EST | 3.14 | down | 0.01902 |
| AA608671 | 1466 | EST | 3.14 | down | 0.04543 |
| W51951 | 3539 | dCMP deaminase | 3.14 | down | 0.01691 |
| AA101055 | 213 | leptin receptor | 3.14 | down | 0.0071 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| J04615 | 2112 | SNRPN upstream reading frame | 3.14 | down | 0.02928 |
| M20902 | 2292 | apolipoprotein C-I | 3.14 | down | 0.0389 |
| L77567 | 2229 | solute carrier family 25 (mitochondrial carrier; citrate transporter), member 1 | 3.14 | down | 0.04095 |
| AA487161 | 1353 | ubiquilin 2 | 3.13 | down | 0.00023 |
| H19504 | 1895 | EST | 3.13 | down | 0.04948 |
| N27524 | 2471 | EST | 3.13 | down | 0.00216 |
| N31952 | 2489 | EST | 3.13 | down | 0.01481 |
| N25193 | 2463 | EST | 3.13 | down | 0.01955 |
| N63688 | 2602 | EST | 3.13 | down | 0.002 |
| N99866 | 2747 | EST | 3.13 | down | 0.04148 |
| AA452915 | 1152 | EST | 3.13 | down | 0.00561 |
| AA477119 | 1289 | EST | 3.13 | down | 0.0338 |
| U25182 | 3332 | thioredoxin peroxidase (antioxidant enzyme) | 3.13 | down | 0.02543 |
| U79294 | 3434 | Phosphatidic acid phosphatase type 2b | 3.13 | down | 0.00129 |
| X17025 | 3712 | isopentenyl-diphosphate delta isomerase | 3.13 | down | 0.0043 |
| L38490 | 2207 | ADP-ribosylation factor 4-like | 3.13 | down | 0.01306 |
| AA402095 | 835 | EST | 3.12 | down | 0.01412 |
| AA479132 | 1309 | EST | 3.12 | down | 0.00876 |
| R67751 | 2938 | EST | 3.12 | down | 0.00319 |
| AA490214 | 1376 | EST | 3.12 | down | 0.02382 |
| H09594 | 1868 | EST | 3.12 | down | 0.00231 |
| H59141 | 1963 | EST | 3.12 | down | 0.00293 |
| T23430 | 3079 | EST | 3.12 | down | 0.00949 |
| T82259 | 3229 | EST | 3.12 | down | 0.01122 |
| Z38435 | 3887 | ribosomal protein L21 | 3.12 | down | 0.03617 |
| AA074891 | 162 | EST | 3.12 | down | 0.01897 |
| AA476346 | 1283 | EST | 3.12 | down | 0.01067 |
| H05072 | 1843 | EST | 3.12 | down | 0.01248 |
| AA405907 | 867 | EST | 3.12 | down | 0 |
| N79435 | 2700 | chromosome 15 open reading frame 3 | 3.12 | down | 0.00861 |
| R44761 | 2857 | aryl hydrocarbon receptor nuclear translocator | 3.12 | down | 0.02663 |
| D13814 | 1611 | angiotensin receptor 1,angiotensin receptor 1B | 3.12 | down | 0.00101 |
| X95876 | 3833 | G protein-coupled receptor 9 | 3.12 | down | 0.001 |
| AA298180 | 726 | EST | 3.11 | down | 0.00747 |
| W35309 | 3499 | EST | 3.11 | down | 0.029 |
| AA243595 | 530 | EST | 3.11 | down | 0.008 |
| AA280791 | 640 | eukaryotic translation initiation factor 5 | 3.11 | down | 0.03339 |
| T68426 | 3185 | CD81 antigen (target of antiproliferative antibody 1) | 3.11 | down | 0.01634 |
| AA401343 | 828 | EST | 3.11 | down | 0.01929 |
| AA454170 | 1163 | EST | 3.11 | down | 0.03 |
| M30257 | 2322 | vascular cell adhesion molecule 1 | 3.11 | down | 0.00064 |
| H67840 | 1980 | EST | 3.1 | down | 0.00528 |
| AA455962 | 1182 | EST | 3.1 | down | 0.03905 |
| AA609576 | 1486 | EST | 3.1 | down | 0.00266 |
| H06144 | 1853 | EST | 3.1 | down | 0.00745 |
| H47391 | 1935 | EST | 3.1 | down | 0.03807 |
| N31598 | 2487 | EST | 3.1 | down | 0.00203 |
| N95585 | 2742 | EST | 3.1 | down | 0.0083 |
| AA457377 | 1201 | EST | 3.1 | down | 0.00549 |
| HG3998–HT4268 | | glycerol-3-phosphate dehydrogenase 1 (soluble) | 3.1 | down | 0.00523 |
| AA247453 | 533 | EST | 3.09 | down | 0.0015 |
| AA284558 | 674 | Nck, Ash and phospholipase C binding protein | 3.09 | down | 0.00027 |
| U06863 | 3287 | follistatin-like 1 | 3.09 | down | 0.00091 |
| AA282179 | 655 | EST | 3.09 | down | 0.01693 |
| AA621430 | 1525 | doublecortex; lissencephaly, X-linked (doublecortin) | 3.09 | down | 0.00024 |
| H82838 | 1971 | EST | 3.09 | down | 0.03201 |
| W67199 | 3566 | EST | 3.09 | down | 0.01528 |
| AA400246 | 810 | mitogen-activated protein kinase-activated protein kinase 2 | 3.09 | down | 0.00476 |
| AA412034 | 894 | EST | 3.09 | down | 0.02309 |
| AA443934 | 1083 | GTP-binding protein Rho7 | 3.09 | down | 0.00214 |
| AA456687 | 1197 | EST | 3.08 | down | 0.01189 |
| R80573 | 2972 | EST | 3.08 | down | 0.02126 |
| R82229 | 2974 | phosphatidylserine decarboxylase | 3.08 | down | 0.03455 |
| W52581 | 3540 | CD36 antigen (collagen type I receptor, thrombospondin receptor)-like 2 (lysosomal integral membrane protein II) | 3.08 | down | 0.00091 |
| N90584 | 2713 | EST | 3.08 | down | 0.02602 |
| AA126059 | 246 | EST | 3.08 | down | 0.00706 |
| AA485326 | 1342 | ATP-binding cassette, sub-family D (ALD), member 4 | 3.08 | down | 0.00415 |
| N21550 | 2443 | EST | 3.08 | down | 0.00006 |
| AA412184 | 898 | EST | 3.08 | down | 0.00012 |
| AA416740 | 907 | EST | 3.08 | down | 0.01592 |
| U73682 | 3419 | meningioma expressed antigen 6 (coiled-coil proline-rich) | 3.08 | down | 0.01249 |
| M16750 | 2273 | pim-1 oncogene | 3.08 | down | 0.01811 |
| Z26491 | 3870 | catechol-O-methyltransferase | 3.08 | down | 0.00877 |

TABLE 6B-continued

Down in Metastatics vs Normal Sample Set 2

| Fragment Name | SEQ ID: | Known Gene Name | Fold Change | Direction | Pvalue |
|---|---|---|---|---|---|
| D58231 | 1692 | ubiquitin-like 3 | 3.07 | down | 0.0002 |
| T94862 | 3257 | EST | 3.07 | down | 0.01417 |
| N34441 | 2495 | EST | 3.07 | down | 0.00186 |
| T16175 | 3063 | protein tyrosine phosphatase, non-receptor type substrate 1 | 3.07 | down | 0.01007 |
| H39119 | 1919 | EST | 3.06 | down | 0.03349 |
| R56602 | 2906 | Ig superfamily protein | 3.06 | down | 0.02464 |
| T49061 | 3134 | EST | 3.06 | down | 0.00768 |
| N68993 | 2640 | EST | 3.06 | down | 0.00867 |
| U36922 | 3351 | EST | 3.06 | down | 0.01388 |
| U69141 | 3413 | glutaryl-Coenzyme A dehydrogenase | 3.06 | down | 0.00053 |
| AA253455 | 565 | EST | 3.05 | down | 0.00533 |
| AA338512 | 742 | EST | 3.05 | down | 0.03427 |
| AA487606 | 1358 | EST | 3.05 | down | 0.00291 |
| R02752 | 2757 | EST | 3.05 | down | 0.00362 |
| M12529 | 2244 | apolipoprotein E | 3.05 | down | 0.03776 |
| T30341 | 3100 | EST | 3.04 | down | 0.04567 |
| AA047187 | 117 | EST | 3.04 | down | 0.04306 |
| R07637 | 2777 | EST | 3.04 | down | 0.00118 |
| R51256 | 2888 | EST | 3.04 | down | 0.00286 |
| W42483 | 3507 | EST | 3.04 | down | 0.02518 |
| X87344 | 3814 | EST | 3.04 | down | 0.02779 |
| AA040270 | 93 | EST | 3.03 | down | 0.01367 |
| R05490 | 2760 | SEC24 (*S. cerevisiae*) related gene family, member B | 3.03 | down | 0.00317 |
| N93246 | 2730 | EST | 3.03 | down | 0.00049 |
| L20965 | 2175 | phosphodiesterase 4A, cAMP-specific (dunce (Drosophila)-homolog phosphodiesterase E2) | 3.02 | down | 0.01177 |
| H57850 | 1958 | protein phosphatase 2 (formerly 2A), regulatory subunit A (PR 65), beta isoform | 3.02 | down | 0.00123 |
| W61319 | 3558 | EST | 3.02 | down | 0.00031 |
| AA599526 | 1453 | cartilage associated protein | 3.02 | down | 0.00043 |
| AA609572 | 1484 | EST | 3.02 | down | 0.01534 |
| AA490890 | 1382 | EST | 3.02 | down | 0.00007 |
| X76105 | 3791 | death-associated protein | 3.02 | down | 0.00944 |
| M92843 | 2420 | zinc finger protein homologous to Zfp-36 in mouse | 3.02 | down | 0.04958 |
| D01686 | 1557 | EST | 3.01 | down | 0.00048 |
| T92950 | 3255 | EST | 3.01 | down | 0.00497 |
| AA349836 | 760 | EST | 3.01 | down | 0.00911 |
| AA401151 | 827 | lysozyme (renal amyloidosis) | 3.01 | down | 0.0051 |
| AA459256 | 1212 | lectin, mannose-binding, 1 | 3.01 | down | 0.00094 |
| AA215585 | 442 | nucix (nucleoside diphosphate linked moiety X)-type motif 3 | 3 | down | 0.03027 |
| AA292711 | 711 | EST | 3 | down | 0.01053 |
| AA410181 | 881 | EST | 3 | down | 0.00268 |
| W70313 | 3575 | EST | 3 | down | 0.00643 |

TABLE 7A

Up in HCC vs Normal Sample Set 2

| Fragment Name | SEQ ID: | Known Gene Name | Fold Change | Direction | Pvalue |
|---|---|---|---|---|---|
| N33920 | 2492 | diubiquitin | 50.29 | up | 0 |
| Y00705 | 3847 | serine protease inhibitor, Kazal type 1 | 28.88 | up | 0.00003 |
| AA398908 | 801 | EST | 20.72 | up | 0.00114 |
| AA099404 | 208 | EST | 20.22 | up | 0 |
| AA610116 | 1499 | tetraspan NET-6 potein | 16.35 | up | 0.00249 |
| N26904 | 2468 | EST | 15.38 | up | 0.00077 |
| R91819 | 2983 | EST | 12.81 | up | 0.00037 |
| AA505133 | 1417 | solute carrier family 2 (facilitated glucose transporter), member 3 | 12.21 | up | 0.00169 |
| AA405791 | 864 | EST | 11.79 | up | 0.00587 |
| N59536 | 2585 | EST | 11.68 | up | 0.00484 |
| AA055896 | 135 | collagen, type V, alpha 1 | 10.87 | up | 0.00907 |
| H99879 | 2084 | EST | 10.81 | up | 0.001 |
| L47125 | 2218 | glypican 3 | 10.69 | up | 0.04129 |
| AA430032 | 1009 | pituitary tumor-transforming 1 | 10.67 | up | 0.00052 |
| Z37987 | 3879 | glypican 3 | 10.66 | up | 0.02304 |
| J03464 | 2094 | collagen, type I, alpha 2 | 10.37 | up | 0.00979 |
| W45320 | 3520 | KRAB-associated protein 1 | 10.05 | up | 0.00002 |
| M94250 | 2425 | midkine (neurite growth-promoting factor 2) | 9.86 | up | 0.02104 |
| AA428172 | 986 | Notch (Drosophila) homolog 3 | 9.63 | up | 0.00195 |
| AA620881 | 1510 | trinucleotide repeat containing 3 | 9.49 | up | 0.00062 |
| AA142857 | 307 | EST | 9.48 | up | 0.00376 |

TABLE 7A-continued

Up in HCC vs Normal Sample Set 2

| Fragment Name | SEQ ID: | Known Gene Name | Fold Change | Direction | Pvalue |
|---|---|---|---|---|---|
| D51276 | 1678 | leukemia-associated phosphoprotein p18 (stathmin) | 9.42 | up | 0.00015 |
| AA156187 | 339 | ATP synthase, H + transporting, mitochondrial F0 complex, subunit b, isoform 1 | 9.38 | up | 0.02007 |
| D31094 | 1639 | G8 protein | 9.37 | up | 0.0048 |
| AA148977 | 322 | EST | 9.3 | up | 0.00002 |
| F08876 | 1797 | EST | 9.06 | up | 0 |
| AA232837 | 465 | EST | 8.85 | up | 0.0048 |
| AA429472 | 997 | DKFZP434P106 protein | 8.78 | up | 0.00063 |
| T24068 | 3087 | EST | 8.65 | up | 0.00118 |
| AA149889 | 326 | neighbor of A-kinase anchoring protein 95 | 8.55 | up | 0.00224 |
| AA398926 | 802 | EST | 8.25 | up | 0.00066 |
| C01766 | 1559 | EST | 8.18 | up | 0.00505 |
| N36432 | 2506 | erythrocyte membrane protein band 4.1-like 2 | 7.95 | up | 0.00067 |
| AA452724 | 1149 | programmed cell death 5 | 7.7 | up | 0.00085 |
| AA401965 | 833 | tumor suppressor deleted in oral cancer-related 1 | 7.58 | up | 0.00089 |
| AA620553 | 1504 | flap structure-specific endonuclease 1 | 7.56 | up | 0.00101 |
| AA024658 | 47 | ribosomal protein S19 | 7.55 | up | 0.00592 |
| AA136269 | 298 | EST | 7.5 | up | 0.00014 |
| H78211 | 2001 | EST | 7.5 | up | 0.02674 |
| AA393139 | 775 | geminin | 7.44 | up | 0.00888 |
| AA251792 | 546 | fatty-acid-Coenzyme A ligase, long-chain 4 | 7.44 | up | 0.00285 |
| AA417030 | 914 | EST | 7.35 | up | 0.00555 |
| AA394258 | 779 | RD RNA-binding protein | 7.27 | up | 0.00054 |
| AA292765 | 712 | ZW10 interactor | 7.24 | up | 0.00498 |
| T16226 | 3065 | EST | 7.23 | up | 0.00119 |
| H08863 | 1859 | hypothetical protein | 7.18 | up | 0.02102 |
| M12125 | 2241 | tropomyosin 2 (beta) | 7.13 | up | 0.0004 |
| R96924 | 3000 | EST | 7.04 | up | 0.00012 |
| AA243133 | 525 | serine/threonine kinase 15 | 7.03 | up | 0.00005 |
| R06986 | 2775 | peptidylprolyl isomerase B (cylophilin B) | 7.03 | up | 0.00628 |
| N93299 | 2731 | nuclear receptor co-repressor 1 | 6.99 | up | 0.0371 |
| Z39682 | 3908 | KIAA0954 protein | 6.96 | up | 0.01966 |
| D26129 | 1635 | ribonuclease, RNase A family, 1 (pancreatic) | 6.9 | up | 0.00008 |
| AA280734 | 639 | KIAA0618 gene product | 6.83 | up | 0.001 |
| T58607 | 3154 | EST | 6.83 | up | 0.03711 |
| H97013 | 2059 | ephrin-A4 | 6.8 | up | 0.00023 |
| AA283182 | 668 | EST | 6.78 | up | 0.01784 |
| M57710 | 2357 | lectin, galactoside-binding, soluble, 3 (galectin 3) | 6.76 | up | 0.00103 |
| AA434418 | 1036 | KIAA1115 protein | 6.75 | up | 0.0032 |
| AA263032 | 614 | ATP synthase, H + transporting, mitochondrial F0 complex, subunit b, isoform 1 | 6.73 | up | 0.04478 |
| AA173755 | 374 | EST | 6.73 | up | 0.00666 |
| AA421951 | 936 | EST | 6.69 | up | 0.00013 |
| W31906 | 3496 | secretagogin | 6.62 | up | 0.00926 |
| AA148885 | 320 | minichromosome maintenance deficient (S. cerevisiae) 4 | 6.59 | up | 0.00112 |
| AA159025 | 353 | EST | 6.58 | up | 0.01946 |
| R44617 | 2856 | MyoD family inhibitor | 6.54 | up | 0.02505 |
| W94885 | 3657 | EST | 6.53 | up | 0 |
| L29218 | 2190 | CDC-like kinase 2 | 6.51 | up | 0.00019 |
| H99473 | 2077 | regulator of nonsense transcripts 1 | 6.51 | up | 0.00025 |
| AA258421 | 595 | hypothetical protein | 6.5 | up | 0.00559 |
| AA454830 | 1170 | DKFZP586M2123 protein | 6.48 | up | 0.00555 |
| R45994 | 2866 | EST | 6.48 | up | 0.00358 |
| AA335191 | 741 | creatine kinase, brain | 6.47 | up | 0.01462 |
| T95057 | 3258 | EST | 6.46 | up | 0.00613 |
| AA011209 | 30 | melanoma-associated antigen recognised by T lymphocytes | 6.45 | up | 0.00088 |
| N73808 | 2678 | EST | 6.44 | up | 0.00352 |
| N62126 | 2588 | EST | 6.42 | up | 0.00109 |
| AA454908 | 1171 | KIAA0144 gene product | 6.39 | up | 0.01863 |
| W80852 | 3606 | KDEL (Lys-Asp-Glu-Leu) endoplasmic reticulum protein retention receptor 3 | 6.37 | up | 0.00005 |
| AA043111 | 97 | EST | 6.36 | up | 0.0005 |
| AA446242 | 1087 | EST | 6.3 | up | 0.00169 |
| F04320 | 1786 | replication factor C (activator 1) 4 (37 kD) | 6.29 | up | 0.00042 |
| H94471 | 2042 | occludin | 6.26 | up | 0.00379 |
| AA284945 | 680 | EST | 6.25 | up | 0.0002 |
| J00231 | 2087 | immunoglobulin heavy constant gamma 3 (G3m marker) | 6.23 | up | 0.00177 |
| AA258131 | 587 | putative GTP-binding protein similar to RAY/RAB1C | 6.23 | up | 0.00931 |
| AA291139 | 695 | EST | 6.22 | up | 0.03491 |
| AA459254 | 1211 | EST | 6.22 | up | 0.00001 |
| H10933 | 1873 | EST | 6.18 | up | 0.00003 |
| R48594 | 2874 | EST | 6.15 | up | 0.03831 |
| AA204927 | 425 | tropomyosin 1 (alpha) | 6.11 | up | 0.0014 |
| AA405098 | 855 | EST | 6.09 | up | 0.01224 |
| T47032 | 3123 | partner of RAC1 (arfaptin 2) | 6.09 | up | 0.00019 |
| W81654 | 3613 | SRY (sex determining region Y)-box 13 | 6.06 | up | 0.00127 |
| R79246 | 2968 | melanoma adhesion molecule | 6.06 | up | 0.00057 |

TABLE 7A-continued

Up in HCC vs Normal Sample Set 2

| Fragment Name | SEQ ID: | Known Gene Name | Fold Change | Direction | Pvalue |
|---|---|---|---|---|---|
| R70801 | 2949 | EST | 6.06 | up | 0.00291 |
| D59355 | 1696 | cytoskeleton-associated protein 1 | 6.05 | up | 0.0015 |
| X05610 | 3682 | collagen, type IV, alpha 2 | 6.04 | up | 0.00062 |
| F01831 | 1773 | EST | 5.95 | up | 0.00532 |
| D59553 | 1697 | golgin-67 | 5.95 | up | 0.00169 |
| Z74616 | 3947 | collagen, type I, alpha 2 | 5.95 | up | 0.02212 |
| AA181705 | 385 | EST | 5.9 | up | 0.00023 |
| C01721 | 1558 | phospholipase C, beta 3, neighbor pseudogene | 5.89 | up | 0.0383 |
| T16550 | 3071 | vacuolar protein sorting 45B (yeast homolog) | 5.88 | up | 0.00004 |
| AA282247 | 657 | EST | 5.88 | up | 0.01112 |
| N54841 | 2571 | EST | 5.87 | up | 0.02752 |
| M31303 | 2327 | leukemia-associated phosphoprotein p18 (stathmin) | 5.86 | up | 0.00071 |
| H05084 | 1844 | EST | 5.85 | up | 0.0059 |
| H27188 | 1908 | collagen-binding protein 2 (colligen 2) | 5.84 | up | 0.01826 |
| AA496981 | 1404 | v-erb-b2 avian erythroblastic leukemia viral oncogene homolog 3 | 5.82 | up | 0.00521 |
| H59617 | 1964 | EST | 5.81 | up | 0.0115 |
| W42957 | 3513 | calmodulin 2 (phosphorylase kinase, delta) | 5.79 | up | 0.03669 |
| AA282343 | 658 | purine-rich element binding protein B | 5.78 | up | 0.00128 |
| AA455239 | 1174 | chromosome-associated polypeptide C | 5.78 | up | 0.00003 |
| AA234096 | 479 | EST | 5.75 | up | 0.01169 |
| U45285 | 3363 | T-cell, immune regulator 1 | 5.75 | up | 0.00006 |
| AA504512 | 1415 | KIAA0943 protein | 5.72 | up | 0.00384 |
| AA443602 | 1078 | EST | 5.71 | up | 0.00736 |
| AA092129 | 194 | EST | 5.67 | up | 0.00011 |
| F02807 | 1781 | KIAA0838 protein | 5.67 | up | 0.02064 |
| N80703 | 2703 | EST | 5.65 | up | 0.0001 |
| AA235448 | 497 | EST | 5.62 | up | 0.00077 |
| AA449073 | 1117 | EST | 5.61 | up | 0.01214 |
| T47325 | 3124 | EST | 5.6 | up | 0.02923 |
| AA135153 | 291 | EST | 5.58 | up | 0.00327 |
| D00596 | 1590 | thymidylate synthetase | 5.58 | up | 0.0098 |
| N72116 | 2667 | solute carrier family 11 (proton-coupled divalent metal ion transporters), member 2 | 5.57 | up | 0.00709 |
| T03580 | 3045 | pyruvate kinase, muscle | 5.57 | up | 0.01344 |
| R07172 | 2776 | EST | 5.54 | up | 0.01322 |
| W78057 | 3597 | EST | 5.53 | up | 0.01231 |
| R72886 | 2955 | KIAA0422 protein | 5.5 | up | 0.00091 |
| AA458878 | 1204 | EST | 5.49 | up | 0.00977 |
| D55716 | 1686 | minichromosome maintenance deficient (*S. cerevisiae*) 7 | 5.48 | up | 0.00003 |
| W26716 | 3481 | non-histone chromosome protein 2 (*S. cerevisiae*)-like 1 | 5.47 | up | 0.00146 |
| AA134052 | 285 | Rab geranylgeranyltransferase, alpha subunit | 5.47 | up | 0.00982 |
| Z74615 | 3946 | collagen, type I, alpha 1 | 5.47 | up | 0.00283 |
| AA410469 | 883 | EST | 5.45 | up | 0.00068 |
| R44793 | 2858 | EST | 5.4 | up | 0.00329 |
| AA133666 | 283 | cysteine-rich protein 2 | 5.35 | up | 0.00433 |
| W02041 | 3465 | EST | 5.34 | up | 0.00027 |
| U75285 | 3421 | apoptosis inhibitor 4 (survivin) | 5.32 | up | 0.01127 |
| AA416970 | 912 | Mad4 homolog | 5.3 | up | 0.00418 |
| AA102489 | 219 | EST | 5.28 | up | 0.02122 |
| T89703 | 3243 | EST | 5.27 | up | 0.00019 |
| N69263 | 2647 | EST | 5.26 | up | 0.0276 |
| T62918 | 3168 | EST | 5.25 | up | 0.00687 |
| AA226932 | 453 | DKFZP564F0923 protein | 5.25 | up | 0.00612 |
| AA007507 | 18 | KIAA1080 protein; Golgi-associated, gamma-adaptin ear containing, ARF-binding protein 2 | 5.23 | up | 0.00159 |
| AA133527 | 281 | EST | 5.23 | up | 0.00037 |
| AA249819 | 535 | EST | 5.22 | up | 0.00049 |
| T15852 | 3061 | EST | 5.21 | up | 0.00642 |
| R39191 | 2833 | KIAA1020 protein | 5.18 | up | 0.03185 |
| M86752 | 2411 | stress-induced-phosphoprotein 1 (Hsp70/Hsp90-organizing protein) | 5.15 | up | 0.02881 |
| T17066 | 3074 | SET domain, bifurcated, 1 | 5.14 | up | 0.00073 |
| W46846 | 3529 | EST | 5.11 | up | 0.00025 |
| F02254 | 1777 | Fas-activated serine/threonine kinase | 5.1 | up | 0.00329 |
| W86748 | 3626 | EST | 5.09 | up | 0.01882 |
| T53590 | 3143 | cytochrome P450, subfamily XIA (cholesterol side chain cleavage) | 5.09 | up | 0.00002 |
| H41529 | 1926 | EST | 5.06 | up | 0.03309 |
| AA608897 | 1473 | EST | 5.05 | up | 0.01782 |
| AA491188 | 1387 | solute carrier family 2 (facilitated glucose transporter), member 3 | 5.04 | up | 0.02291 |
| AA026356 | 57 | EST | 5.04 | up | 0.02483 |
| W46634 | 3527 | EST | 5.03 | up | 0.02152 |
| AA460909 | 1232 | EST | 5.02 | up | 0.01354 |
| AA421562 | 934 | anterior gradient 2 (*Xenopus laevis*) homolog | 5.02 | up | 0.02818 |
| AA027833 | 59 | EST | 5.02 | up | 0.01123 |
| AA435748 | 1044 | EST | 5.01 | up | 0.01812 |
| R44839 | 2860 | i-beta-1,3-N-acetylglucosaminyltransferase | 5 | up | 0.01812 |

TABLE 7A-continued

Up in HCC vs Normal Sample Set 2

| Fragment Name | SEQ ID: | Known Gene Name | Fold Change | Direction | Pvalue |
|---|---|---|---|---|---|
| T67053 | 3179 | EST | 5 | up | 0.01846 |
| AA470156 | 1276 | EST | 4.99 | up | 0.0206 |
| R70005 | 2943 | EST | 4.98 | up | 0.00007 |
| W80763 | 3605 | EST | 4.98 | up | 0.01026 |
| T33508 | 3105 | phosphatidylinositol-4-phosphate 5-kinase, type II, beta | 4.96 | up | 0.00064 |
| AA442054 | 1067 | phospholipase C, gamma 1 (formerly subtype 148) | 4.94 | up | 0.04102 |
| H28333 | 1912 | melanoma adhesion molecule | 4.94 | up | 0.00166 |
| R49476 | 2882 | EST | 4.93 | up | 0.00763 |
| AA291168 | 696 | EST | 4.93 | up | 0.01633 |
| AA410962 | 887 | peroxisome proliferative activated receptor, delta | 4.91 | up | 0.0044 |
| N93798 | 2737 | protein tyrosine phosphatase type IVA, member 3 | 4.91 | up | 0.00245 |
| W85875 | 3617 | EST | 4.91 | up | 0.01198 |
| AA089997 | 189 | EST | 4.9 | up | 0.0241 |
| AA482319 | 1335 | putative type II membrane protein | 4.9 | up | 0.00028 |
| AA037433 | 86 | EST | 4.9 | up | 0.0194 |
| W79773 | 3602 | EST | 4.89 | up | 0.00034 |
| AA188378 | 392 | EST | 4.88 | up | 0.01653 |
| AA252060 | 550 | EST | 4.88 | up | 0.00169 |
| F01538 | 1771 | RAP1, GTPase activating protein 1 | 4.88 | up | 0.00292 |
| R06251 | 2763 | tumor protein D52-like 2 | 4.88 | up | 0.03097 |
| T90190 | 3246 | H1 histone family, member 2 | 4.88 | up | 0.00555 |
| AA281599 | 647 | EST | 4.87 | up | 0.00248 |
| T88814 | 3241 | EST | 4.87 | up | 0.00001 |
| W92608 | 3650 | BAI1-associated protein 3 | 4.84 | up | 0.00599 |
| AA477549 | 1291 | T-cell, immune regulator 1 | 4.84 | up | 0.04096 |
| W73038 | 3585 | EST | 4.83 | up | 0.00902 |
| S78187 | 3035 | cell division cycle 25B | 4.83 | up | 0.00547 |
| N54067 | 2561 | mitogen-activated protein kinase kinase kinase kinase 4 | 4.82 | up | 0.00229 |
| W60097 | 3553 | DEAD/H (Asp-Glu-Ala-Asp/His) box polypeptide, Y chromosome | 4.82 | up | 0.04903 |
| AA215299 | 439 | U6 snRNA-associated Sm-like protein LSm7 | 4.81 | up | 0.00119 |
| AA497018 | 1406 | adenylate cyclase 1 (brain) | 4.81 | up | 0.00352 |
| AA115735 | 230 | EST | 4.8 | up | 0.02671 |
| C14051 | 1565 | phosphoprotein enriched in astrocytes 15 | 4.79 | up | 0.00548 |
| H09271 | 1862 | EST | 4.78 | up | 0.00072 |
| AA482104 | 1332 | non-metastatic cells 3, protein expressed in | 4.78 | up | 0.00135 |
| AA283832 | 672 | EST | 4.77 | up | 0.00156 |
| AA464963 | 1265 | EST | 4.77 | up | 0.00086 |
| R48447 | 2870 | EST | 4.76 | up | 0.00533 |
| AA251299 | 541 | KIAA0014 gene product | 4.74 | up | 0.0252 |
| H64493 | 1973 | immunoglobulin heavy constant gamma 3 (G3m marker) | 4.74 | up | 0.00751 |
| M60784 | 2366 | small nuclear ribonucleoprotein polypeptide A | 4.74 | up | 0.00001 |
| AA146849 | 313 | target of myb1 (chicken) homolog | 4.72 | up | 0.00326 |
| AA179787 | 380 | polyglutamine binding protein 1 | 4.71 | up | 0.00725 |
| AA430474 | 1015 | EST | 4.69 | up | 0.00007 |
| Z38462 | 3889 | KIAA0938 protein | 4.69 | up | 0.0142 |
| AA489712 | 1372 | EST | 4.69 | up | 0.00587 |
| R52649 | 2893 | EST | 4.69 | up | 0.00135 |
| AA424487 | 945 | EST | 4.68 | up | 0.0013 |
| D82558 | 1746 | novel centrosomal protein RanBPM | 4.67 | up | 0.00458 |
| X99920 | 3840 | S100 calcium-binding protein A13 | 4.66 | up | 0.00113 |
| M35252 | 2343 | transmembrane 4 superfamily member 3 | 4.65 | up | 0.04128 |
| U73377 | 3416 | SHC (Src homology 2 domain-containing) transforming protein 1 | 4.64 | up | 0.00081 |
| X57129 | 3740 | H1 histone family, member 2 | 4.63 | up | 0.00663 |
| L28821 | 2188 | mannosidase, alpha, class 2A, member 2 | 4.63 | up | 0.00876 |
| AA431571 | 1024 | EST | 4.62 | up | 0.0174 |
| C14098 | 1566 | EST | 4.62 | up | 0.01654 |
| R96527 | 2998 | KIAA0253 protein | 4.62 | up | 0.00702 |
| AA451877 | 1138 | EST | 4.6 | up | 0.04045 |
| T33489 | 3104 | EST | 4.6 | up | 0.00285 |
| M27830 | 2314 | EST | 4.6 | up | 0.04719 |
| AA621242 | 1518 | hypothetical protein, peptidylprolyl isomerase B (cyclophilin B) | 4.59 | up | 0.00081 |
| M87339 | 2414 | replication factor C (activator 1) 4 (37 kD) | 4.59 | up | 0.00116 |
| H46486 | 1932 | nesca protein | 4.57 | up | 0.00749 |
| AA262477 | 608 | ribonuclease HI, large subunit | 4.57 | up | 0.00724 |
| AA194730 | 410 | EST | 4.57 | up | 0.00801 |
| R49708 | 2885 | EST | 4.56 | up | 0.03767 |
| T34377 | 3110 | potassium voltage-gated channel, shaker-related subfamily, beta member 2 | 4.55 | up | 0.00041 |
| AA424029 | 943 | EST | 4.54 | up | 0.02721 |
| AA151435 | 336 | EST | 4.52 | up | 0.01134 |
| AA086232 | 186 | kangai 1 (suppression of tumorigenicity 6, prostate; CD82 antigen (R2 leukocyte antigen, antigen detected by monoclonal and antibody IA4)) | 4.52 | up | 0.00452 |
| AA280840 | 641 | casein kinase 1, gamma 2 | 4.51 | up | 0.0186 |
| AA127741 | 256 | EST | 4.49 | up | 0.0463 |
| H86072 | 2015 | EST | 4.49 | up | 0.01301 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA482224 | 1334 | putative type II membrane protein | 4.47 | up | 0.0001 |
| U47025 | 3367 | phosphorylase, glycogen; brain | 4.47 | up | 0.00037 |
| T30214 | 3098 | EST | 4.46 | up | 0.03654 |
| W70336 | 3576 | EST | 4.46 | up | 0.00023 |
| AA251769 | 544 | EST | 4.45 | up | 0.01431 |
| L17131 | 2168 | high-mobility group (nonhistone chromosomal) protein isoforms I and Y | 4.45 | up | 0.03141 |
| AA001504 | 2 | EST | 4.44 | up | 0.03077 |
| AA215379 | 440 | EST | 4.44 | up | 0.01675 |
| H99587 | 2079 | EST | 4.44 | up | 0.00532 |
| AA487218 | 1355 | EST | 4.43 | up | 0.03198 |
| N75541 | 2691 | EST | 4.43 | up | 0.01059 |
| N73865 | 2680 | EST | 4.43 | up | 0.00177 |
| L25876 | 2182 | cyclin-dependent kinase inhibitor 3 (CDK2-associated dual specificity phosphatase) | 4.43 | up | 0.00082 |
| AB002373 | 1538 | KIAA0375 gene product | 4.41 | up | 0.00795 |
| H57709 | 1956 | ribosomal protein L31 | 4.41 | up | 0.00091 |
| F13809 | 1828 | tropomyosin 1 (alpha) | 4.4 | up | 0.01221 |
| T79477 | 3222 | death-associated protein 6 | 4.4 | up | 0.00074 |
| AA156460 | 343 | EST | 4.39 | up | 0.01223 |
| AA171760 | 367 | EST | 4.39 | up | 0.04582 |
| AA423827 | 941 | chromosome 22 open reading frame 3 | 4.39 | up | 0.00345 |
| W28362 | 3487 | KIAA0974 protein | 4.38 | up | 0.00322 |
| W69302 | 3570 | EST | 4.37 | up | 0.00165 |
| AA236672 | 515 | EST | 4.37 | up | 0.00385 |
| AA043959 | 101 | tropomyosin 4 | 4.37 | up | 0.01641 |
| AA070827 | 157 | EST | 4.37 | up | 0.02617 |
| W42627 | 3508 | EST | 4.37 | up | 0.00021 |
| D82226 | 1742 | proteasome (prosome, macropain) 26S subunit, ATPase, 4 | 4.35 | up | 0.00184 |
| L33930 | 2198 | CD24 antigen (small cell lung carcinoma cluster 4 antigen) | 4.35 | up | 0.03968 |
| AA218663 | 444 | acid-inducible phosphoprotein | 4.34 | up | 0.00161 |
| D59570 | 1699 | EST | 4.34 | up | 0.00487 |
| D60811 | 1704 | EST | 4.34 | up | 0.00217 |
| H70739 | 1991 | EST | 4.34 | up | 0.00106 |
| H97677 | 2062 | EST | 4.34 | up | 0.00753 |
| R92449 | 2984 | KIAA0323 protein | 4.34 | up | 0.00104 |
| R61374 | 2920 | EST | 4.33 | up | 0.01489 |
| N68241 | 2633 | EST | 4.32 | up | 0.00532 |
| AA430048 | 1012 | KIAA0160 protein | 4.32 | up | 0.00279 |
| AA235289 | 495 | RAP2A, member of RAS oncogene family | 4.31 | up | 0.00135 |
| N91773 | 2718 | lysyl oxidase | 4.31 | up | 0.00302 |
| AA429539 | 999 | EST | 4.3 | up | 0.01035 |
| AA399251 | 804 | EST | 4.3 | up | 0.01578 |
| AA461063 | 1235 | EST | 4.3 | up | 0.00074 |
| W86214 | 3622 | EST | 4.3 | up | 0.00194 |
| M19267 | 2286 | tropomyosin 1 (alpha) | 4.3 | up | 0.00893 |
| AA416973 | 913 | EST | 4.29 | up | 0.00155 |
| T16206 | 3064 | EST | 4.29 | up | 0.00868 |
| AA252627 | 556 | chaperonin containing TCP1, subunit 6A (zeta 1), homeo box B5 | 4.28 | up | 0.00363 |
| W60486 | 3555 | EST | 4.27 | up | 0.0046 |
| AA478017 | 1295 | zyxin | 4.25 | up | 0.01223 |
| M37583 | 2349 | H2A histone family, member Z | 4.25 | up | 0.00135 |
| T55196 | 3146 | EST | 4.24 | up | 0.00046 |
| AA454597 | 1166 | EST | 4.23 | up | 0.00917 |
| T03749 | 3047 | KIAA1089 protein | 4.23 | up | 0.00776 |
| AA256688 | 584 | EST | 4.23 | up | 0.03094 |
| T16983 | 3073 | cleavage and polyadenylation specific factor 4, 30 kD subunit | 4.23 | up | 0.0106 |
| AA398205 | 789 | EST | 4.22 | up | 0.00059 |
| AA488432 | 1361 | phosphoserine phosphatase | 4.2 | up | 0.00128 |
| R05316 | 2759 | EST | 4.2 | up | 0.00011 |
| AA136547 | 302 | EST | 4.19 | up | 0.00098 |
| AA112679 | 224 | EST | 4.19 | up | 0.00572 |
| R39390 | 2836 | EST | 4.18 | up | 0.0004 |
| D83783 | 1748 | trinucleotide repeat containing 11 (THR-associated protein, 230 kDa subunit | 4.16 | up | 0.00055 |
| AA291786 | 704 | FE65-LIKE 2 | 4.15 | up | 0.00362 |
| AA291659 | 702 | EST | 4.15 | up | 0.00019 |
| H88674 | 2021 | collagen, type I, alpha 2 | 4.15 | up | 0.02664 |
| AA488892 | 1364 | EST | 4.14 | up | 0.04766 |
| F01568 | 1772 | EST | 4.13 | up | 0.00084 |
| F04444 | 1788 | EST | 4.13 | up | 0.00944 |
| N70481 | 2657 | EST | 4.13 | up | 0.0099 |
| AA102837 | 221 | EST | 4.13 | up | 0.0067 |
| AA365742 | 765 | tetraspan NET-6 protein | 4.12 | up | 0.00255 |
| R71395 | 2951 | EST | 4.12 | up | 0.03719 |
| AA447574 | 1102 | EST | 4.12 | up | 0.00779 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA400184 | 809 | KIAA0907 protein | 4.11 | up | 0.01123 |
| AA211483 | 435 | EST | 4.11 | up | 0.0365 |
| AA037058 | 84 | laminin, gamma 1 (formerly LAMB2) | 4.11 | up | 0.02264 |
| W44557 | 3515 | chromosome 1 open reading frame 2 | 4.1 | up | 0.00433 |
| T62521 | 3167 | EST | 4.1 | up | 0.00392 |
| D38073 | 1651 | minichromosome maintenance deficient (*S. cerevisiae*) 3 | 4.1 | up | 0.01195 |
| N92948 | 2725 | nuclear phosphoprotein similar to *S. cerevisiae* PWP1 | 4.09 | up | 0.0019 |
| AA464414 | 1258 | EST | 4.08 | up | 0.02299 |
| AA142858 | 308 | EST | 4.07 | up | 0.0022 |
| AA610089 | 1498 | U4/U6-associated RNA splicing factor | 4.07 | up | 0.00361 |
| Z39200 | 3899 | EST | 4.07 | up | 0.00075 |
| AA443802 | 1081 | EST | 4.07 | up | 0.01546 |
| AA453783 | 1158 | EST | 4.07 | up | 0.00786 |
| AA053680 | 130 | high-mobility group protein 2-like 1 | 4.07 | up | 0.03144 |
| L03411 | 2134 | RD RNA-binding protein | 4.06 | up | 0.00467 |
| AA405505 | 860 | RNA helicase family | 4.05 | up | 0.00747 |
| AA293420 | 717 | EST | 4.05 | up | 0.01189 |
| AA400643 | 817 | GAS2-related on chromosome 22 | 4.04 | up | 0.03751 |
| AA609008 | 1475 | EST | 4.04 | up | 0.00002 |
| N56935 | 2574 | EST | 4.04 | up | 0.00797 |
| AA446581 | 1090 | DKFZP564P0462 protein | 4.04 | up | 0.00479 |
| H52937 | 1944 | roundabout (axon guidance receptor, Drosophila) homolog 1 | 4.02 | up | 0.00163 |
| D42040 | 1657 | female sterile homeotic-related gene 1 (mouse homolog) | 4.02 | up | 0.00389 |
| W04550 | 3469 | EST | 4.01 | up | 0.00349 |
| AA460665 | 1230 | EST | 4.01 | up | 0.01866 |
| AA463254 | 1247 | histone deacetylase 3 | 4.01 | up | 0.01856 |
| U85625 | 3447 | ribonuclease 6 precursor | 4 | up | 0.01664 |
| T77733 | 3218 | tubulin, gamma 1 | 4 | up | 0.00526 |
| AA464043 | 1255 | EST | 3.99 | up | 0.00056 |
| N69390 | 2649 | EST | 3.99 | up | 0.00016 |
| X54941 | 3729 | CDC28 protein kinase 1 | 3.99 | up | 0.0016 |
| HG2259-HT2348 | | tubulin, alpha 1 (testis specific), tubulin, alpha, ubiquitous | 3.99 | up | 0.00945 |
| AA425852 | 958 | EST | 3.98 | up | 0.02796 |
| D84557 | 1749 | minichromosome maintenance deficient (mis5, *S. pombe*) 6 | 3.97 | up | 0.0017 |
| AA338760 | 744 | EST | 3.96 | up | 0.01307 |
| R45569 | 2863 | DKFZP547E1010 protein | 3.96 | up | 0.00259 |
| X17567 | 3716 | small nuclear ribonucleoprotein polypeptides B and B1 | 3.96 | up | 0.00317 |
| M68864 | 2389 | ORF | 3.95 | up | 0.00144 |
| X53331 | 3724 | matrix Gla protein | 3.95 | up | 0.0151 |
| AA258614 | 599 | EST | 3.94 | up | 0.0048 |
| T65957 | 3175 | ribosomal protein S3A | 3.94 | up | 0.04187 |
| AA435665 | 1040 | EST | 3.94 | up | 0.00274 |
| M32977 | 2336 | vascular endothelial growth factor | 3.93 | up | 0.04917 |
| F10199 | 1813 | EST | 3.93 | up | 0.03209 |
| AA256606 | 581 | EST | 3.92 | up | 0.03087 |
| R61557 | 2921 | KIAA0100 gene product | 3.9 | up | 0.00292 |
| T33859 | 3108 | KIAA0365 gene product | 3.9 | up | 0.0019 |
| U18018 | 3316 | ets variant gene 4 (E1A enhancer-binding protein, E1AF) | 3.9 | up | 0.0403 |
| T78922 | 3221 | stem cell growth factor; lymphocyte secreted C-type lectin | 3.89 | up | 0.00604 |
| D63478 | 1711 | KIAA0144 gene product | 3.89 | up | 0.00253 |
| AA320369 | 735 | chromosome 19 open reading frame 3 | 3.88 | up | 0.00452 |
| AA598405 | 1424 | membrane interacting protein of RGS16 | 3.87 | up | 0.00649 |
| AA127444 | 252 | EST | 3.87 | up | 0.01751 |
| AA465000 | 1266 | EST | 3.86 | up | 0.00431 |
| D80420 | 1732 | ubiquinol-cytochrome c reductase hinge protein | 3.86 | up | 0.00412 |
| T10698 | 3053 | EST | 3.86 | up | 0.00195 |
| X74801 | 3788 | chaperonin containing TCP1, subunit 3 (gamma) | 3.86 | up | 0.00453 |
| AA451680 | 1136 | hepatocellular carcinoma associated protein; breast cancer associated gene 1 | 3.85 | up | 0.0018 |
| L76191 | 2222 | interleukin-1 receptor-associated kinase 1 | 3.85 | up | 0.00152 |
| N68018 | 2630 | TBP-associated factor 172 | 3.84 | up | 0.00277 |
| AA132032 | 271 | trinucleotide repeat containing 1 | 3.84 | up | 0.01136 |
| N67815 | 2626 | EST | 3.84 | up | 0.00439 |
| D14657 | 1615 | KIAA0101 gene product | 3.84 | up | 0.02048 |
| AA478422 | 1301 | unc-51 (C. elegans)-like kinase 1 | 3.83 | up | 0.00116 |
| AA485060 | 1339 | EST | 3.83 | up | 0.03172 |
| AA101272 | 215 | EST | 3.83 | up | 0.0386 |
| AA425852 | 958 | EST | 3.82 | up | 0.0395 |
| L29218 | 2190 | CDC-like kinase 2 | 3.82 | up | 0.00035 |
| AA485431 | 1345 | EST | 3.81 | up | 0.00441 |
| AA233897 | 476 | EST | 3.8 | up | 0.02145 |
| R26744 | 2803 | midline 1 (Opitz/BBB syndrome) | 3.8 | up | 0.00266 |
| AA160775 | 355 | BCL2-antagonist of cell death | 3.8 | up | 0.01145 |
| X54942 | 3730 | CDC28 protein kinase 2 | 3.8 | up | 0.0035 |
| T03438 | 3042 | EST | 3.79 | up | 0.02042 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA182001 | 386 | EST | 3.78 | up | 0.04446 |
| N70678 | 2659 | TAR (HIV) RNA-binding protein 1 | 3.78 | up | 0.02858 |
| L25444 | 2181 | TATA box binding protein (TBP)-associated factor, RNA polymerase II, E, 70/85 kD | 3.78 | up | 0.00011 |
| AA086071 | 184 | chromosome-associated polypeptide C | 3.77 | up | 0.01993 |
| AA278768 | 617 | EST | 3.77 | up | 0.03239 |
| Z39379 | 3900 | EST | 3.77 | up | 0.00513 |
| J03040 | 2091 | secreted protein, acidic, cysteine-rich (osteonectin) | 3.77 | up | 0.00594 |
| AA449431 | 1124 | translation initiation factor IF2 | 3.76 | up | 0.00571 |
| T26471 | 3093 | EST | 3.76 | up | 0.0165 |
| AA262957 | 612 | EST | 3.76 | up | 0.00157 |
| N47956 | 2523 | eukaryotic translation initiation factor 3, subunit 3 (gamma, 40 kD) | 3.76 | up | 0.00968 |
| AA478300 | 1298 | CD39-like 2 | 3.75 | up | 0.00152 |
| C14756 | 1570 | MLN51 protein | 3.75 | up | 0.0226 |
| N73705 | 2676 | EST | 3.75 | up | 0.01762 |
| AA046103 | 109 | EST | 3.75 | up | 0.02893 |
| AA076138 | 167 | H2A histone family, member Y | 3.75 | up | 0.01442 |
| AA129757 | 264 | EST | 3.75 | up | 0.0166 |
| H99877 | 2083 | exportin, tRNA (nuclear export receptor for tRNAs) | 3.75 | up | 0.00302 |
| AA488074 | 1360 | cell division cycle 42 (GTP-binding protein, 25 kD) | 3.74 | up | 0.01887 |
| H00540 | 1829 | EST | 3.74 | up | 0.00234 |
| AA173430 | 371 | EST | 3.74 | up | 0.01159 |
| N29742 | 2480 | EST | 3.74 | up | 0.00104 |
| AA402272 | 837 | EST | 3.73 | up | 0.02336 |
| AA404560 | 853 | O-linked N-acetylglucosamine (GlcNAc) transferase (UDP-N-acetylgluosamine:polypeptide-N-acetylglucosaminyl transferase) | 3.73 | up | 0.0143 |
| N21648 | 2446 | MpV17 transgene, murine homolog, glomerulosclerosis | 3.73 | up | 0.00071 |
| H56345 | 1950 | EST | 3.73 | up | 0.00853 |
| R76782 | 2962 | O-linked N-acetylglucosamine (GlcNAc) transferase (UDP-N-acetylglucosamine:polypeptide-N-acetylgluosaminyl transferase) | 3.73 | up | 0.00094 |
| J05614 | 2122 | EST | 3.73 | up | 0.03419 |
| AA461476 | 1243 | EST | 3.72 | up | 0.00744 |
| AA255486 | 568 | EST | 3.72 | up | 0.00154 |
| AA423841 | 942 | EST | 3.71 | up | 0.01481 |
| AA491295 | 1390 | calcium/calmodulin-dependent protein kinase kinase 2, beta | 3.71 | up | 0.0103 |
| Z38299 | 3884 | EST | 3.71 | up | 0.0036 |
| AA600153 | 1460 | DEK oncogene (DNA binding) | 3.71 | up | 0.02967 |
| AA609080 | 1478 | EST | 3.71 | up | 0.0306 |
| AA010065 | 22 | CDC28 protein kinase 2 | 3.71 | up | 0.00432 |
| D31417 | 1645 | secreted protein of unknown funtion | 3.69 | up | 0.0004 |
| AA018346 | 38 | EST | 3.69 | up | 0.04582 |
| N69252 | 2646 | ferritin, light polypeptide | 3.69 | up | 0.04116 |
| Z23090 | 3865 | heat shock 27 kD protein 1 | 3.69 | up | 0.00628 |
| AA402968 | 844 | EST | 3.68 | up | 0.00123 |
| N98464 | 2743 | EST | 3.68 | up | 0.03007 |
| AA165526 | 360 | 3-prime-phosphoadenosine 5-prime-phosphosulfate synthase 1 | 3.68 | up | 0.00021 |
| W46286 | 3523 | EST | 3.68 | up | 0.00311 |
| M21259 | 2293 | small nuclear ribonucleoprotein polypeptide E | 3.68 | up | 0.00415 |
| U91930 | 3459 | adaptor-related protein complex 3, delta 1 subunit | 3.68 | up | 0.00009 |
| F09788 | 1808 | procollagen-proline. 2-oxoglutarate 4-dioxygenase (proline 4-hydroxylase), alpha polypeptide II | 3.67 | up | 0.01682 |
| AA291137 | 694 | EST | 3.67 | up | 0.03243 |
| H68794 | 1984 | EST | 3.67 | up | 0.00327 |
| N73762 | 2677 | EST | 3.67 | up | 0.00796 |
| R56095 | 2905 | EST | 3.67 | up | 0.0158 |
| R77451 | 2963 | EST | 3.67 | up | 0.00078 |
| N52168 | 2550 | EST | 3.66 | up | 0.00127 |
| AA456852 | 1199 | suppressor of white apricot homolog 2 | 3.66 | up | 0.00614 |
| X83425 | 3809 | Lutheran blood group (Auberger b antigen included) | 3.66 | up | 0.02661 |
| H47357 | 1934 | EST | 3.65 | up | 0.03799 |
| AA292788 | 714 | EST | 3.65 | up | 0.01765 |
| U51586 | 3385 | siah binding protein 1; FBP interacting repressor; pyrimidine tract binding splicing factor; Ro ribonucleoprotein-binding protein 1 | 3.65 | up | 0.00403 |
| X56494 | 3735 | pyruvate kinase, muscle | 3.65 | up | 0.04795 |
| F10453 | 1819 | EST | 3.64 | up | 0.01878 |
| T23465 | 3080 | EST | 3.64 | up | 0.00265 |
| Z24727 | 3868 | tropomyosin 1 (alpha) | 3.64 | up | 0.00388 |
| X57809 | 3743 | immunoglobulin lambda locus | 3.64 | up | 0.02655 |
| AA040465 | 95 | EST | 3.63 | up | 0.01806 |
| T16652 | 3072 | BCS1 (yeast homolog)-like | 3.63 | up | 0.00434 |
| AA037766 | 87 | EST | 3.63 | up | 0.0328 |
| AA227541 | 457 | NS1-binding protein | 3.6 | up | 0.02801 |
| AA313213 | 732 | flotillin 1 | 3.59 | up | 0.00878 |
| AA251909 | 549 | EST | 3.59 | up | 0.01129 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA487856 | 1359 | KIAA0676 protein | 3.59 | up | 0.01408 |
| M63573 | 2377 | peptidylprolyl isomerase B (cyclophilin B) | 3.59 | up | 0.00916 |
| M94345 | 2426 | capping protein (acetin filament), gelsolin-like | 3.59 | up | 0.04508 |
| AF003521 | 1545 | jagged 2 | 3.58 | up | 0.00299 |
| AA489091 | 1368 | EST | 3.58 | up | 0.0002 |
| W49791 | 3538 | plasminogen activator, tissue | 3.58 | up | 0.02438 |
| W90146 | 3641 | EST | 3.58 | up | 0.00322 |
| Z39429 | 3903 | EST | 3.58 | up | 0.00416 |
| X06700 | 3685 | collagen, type III, alpha 1 (Ehlers-Danlos syndrome type IV, autosomal dominant) | 3.58 | up | 0.02964 |
| W79421 | 3600 | EST | 3.57 | up | 0.00895 |
| X64364 | 3761 | basigin | 3.57 | up | 0.00902 |
| Z21507 | 3864 | eukaryotic translation elongation factor 1 delta (guanine nucleotide exchange protein) | 3.57 | up | 0.01898 |
| U62392 | 3402 | zinc finger protein 193 | 3.56 | up | 0.0407 |
| AA135871 | 294 | EST | 3.56 | up | 0.01718 |
| W72276 | 3580 | EST | 3.56 | up | 0.0476 |
| D63486 | 1712 | KIAA0152 gene product | 3.56 | up | 0.00063 |
| AA258182 | 589 | EST | 3.55 | up | 0.01198 |
| AA179845 | 381 | EST | 3.55 | up | 0.02484 |
| AA599850 | 1457 | EST | 3.55 | up | 0.03215 |
| D13640 | 1608 | KIAA0015 gene product | 3.55 | up | 0.00347 |
| U66661 | 3405 | gamma-aminobutyric acid (GABA) A receptor, epsilon | 3.55 | up | 0.0045 |
| R73569 | 2959 | EST | 3.54 | up | 0.01962 |
| Z40006 | 3914 | EST | 3.54 | up | 0.00156 |
| AA400896 | 822 | EST | 3.54 | up | 0.00889 |
| N98758 | 2744 | EST | 3.54 | up | 0.02609 |
| M27830 | 2314 | EST | 3.54 | up | 0.00777 |
| U90551 | 3456 | H2A histone family, member L | 3.54 | up | 0.01523 |
| M55998 | 2356 | collagen, type I, alpha 1 | 3.54 | up | 0.01449 |
| AA485697 | 1346 | EST | 3.53 | up | 0.03566 |
| H07873 | 1856 | EST | 3.53 | up | 0.0391 |
| R06254 | 2764 | tumor protein D52-like 2 | 3.53 | up | 0.04865 |
| R27016 | 2805 | myristoylated alanine-rich protein kinase C substrate (MARCKS, 80K-L) | 3.53 | up | 0.03056 |
| U26727 | 3336 | cyclin-dependent kinase inhibtor 2A (melanoma, p16, inhibits CDK4) | 3.53 | up | 0.02913 |
| D81608 | 1740 | polymerase (RNA) II (DNA directed) polypeptide K (7.0 kD) | 3.52 | up | 0.00437 |
| R22565 | 2799 | EST | 3.52 | up | 0.04352 |
| T17353 | 3076 | EST | 3.52 | up | 0.02085 |
| AA409212 | 1375 | H2A histone family, member Y | 3.52 | up | 0.02202 |
| R66469 | 2936 | pleckstrin and Sec7 domain protein | 3.52 | up | 0.0272 |
| AA464722 | 1263 | DKFZP566C243 protein | 3.51 | up | 0.00101 |
| H97012 | 2058 | EST | 3.51 | up | 0.03505 |
| T23426 | 3078 | EST | 3.51 | up | 0.00674 |
| AA399264 | 805 | EST | 3.51 | up | 0.00327 |
| H99774 | 2081 | EST | 3.51 | up | 0.00009 |
| W94281 | 3655 | integral membrane protein 2C | 3.51 | up | 0.01689 |
| X54667 | 3728 | cystatin S,cystatin SN | 3.51 | up | 0.00187 |
| AA278817 | 618 | EST | 3.5 | up | 0.01159 |
| AA489707 | 1371 | EST | 3.5 | up | 0.03208 |
| T59668 | 3159 | lysyl oxidase | 3.5 | up | 0.00083 |
| AA598447 | 1428 | exportin, tRNA (nuclear export receptor for tRNAs) | 3.5 | up | 0.01201 |
| H91632 | 2031 | EST | 3.5 | up | 0.03688 |
| N51771 | 2547 | KIAA0652 gene product | 3.5 | up | 0.00028 |
| R33498 | 2819 | EST | 3.5 | up | 0.03336 |
| AA621409 | 1524 | putative type II membrane protein | 3.5 | up | 0.00462 |
| L04270 | 2135 | lymphotoxin beta receptor (TNFR superfamily, member 3 | 3.5 | up | 0.01547 |
| AA243173 | 526 | EST | 3.49 | up | 0.0401 |
| AA442763 | 1072 | cyclin B2 | 3.49 | up | 0.04176 |
| AA235868 | 504 | nuclear transcription factor Y, beta | 3.49 | up | 0.01897 |
| T26646 | 3096 | X-ray repair complementing defective repair in Chinese hamster cells 1 | 3.49 | up | 0.02482 |
| M34309 | 2342 | v-erb-b2 avian erythroblastic leukemia viral oncogene homolog 3 | 3.49 | up | 0.00191 |
| N35913 | 2502 | EST | 3.48 | up | 0.0016 |
| M26576 | 2310 | EST | 3.48 | up | 0.00062 |
| Y08302 | 3849 | dual specificity phosphatase 9 | 3.48 | up | 0.00787 |
| Z39191 | 3898 | EST | 3.47 | up | 0.00756 |
| N21407 | 2442 | EST | 3.47 | up | 0.01037 |
| M55210 | 2353 | laminin, gamma 1 (formerly LAMB2) | 3.47 | up | 0.02551 |
| AA236150 | 507 | 3-prime-phosphoadenosine 5-prime-phosphosulfate synthase 1 | 3.46 | up | 0.0008 |
| R48473 | 2871 | EST | 3.46 | up | 0.01196 |
| N99944 | 2748 | EST | 3.46 | up | 0.00104 |
| AA598648 | 1432 | SWI/SNF related, matrix associated, actin dependent regulator of chromatin) subfamily a, member 4 | 3.46 | up | 0.00293 |
| C00358 | 1552 | nucleolar protein 3 (apoptosis repressor with CARD domain) | 3.45 | up | 0.00985 |
| AA464251 | 1257 | EST | 3.45 | up | 0.02229 |
| AA598712 | 1436 | EST | 3.45 | up | 0.00005 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA620461 | 1501 | EST | 3.45 | up | 0.01146 |
| R91753 | 2982 | EST | 3.45 | up | 0.02391 |
| Z41349 | 3928 | EST | 3.45 | up | 0.01503 |
| N39237 | 2510 | EST | 3.45 | up | 0.02481 |
| HG4074-HT4344 | | flap structure-specific endonuclease 1 | 3.45 | up | 0.01695 |
| U24704 | 3331 | proteasome (prosome, macropain) 26S subunit, non-ATPase, 4 | 3.45 | up | 0.00037 |
| X87212 | 3813 | cathepsin C | 3.45 | up | 0.02486 |
| AA094752 | 203 | hypothetical 43.2 Kd protein | 3.44 | up | 0.04445 |
| AA471384 | 1278 | divalent cation tolerant protein CUTA | 3.44 | up | 0.01161 |
| AA443271 | 1073 | KIAA0546 protein | 3.44 | up | 0.00324 |
| R62456 | 2924 | EST | 3.44 | up | 0.00285 |
| R70532 | 2946 | EST | 3.44 | up | 0.02186 |
| T51972 | 3139 | EST | 3.44 | up | 0.00406 |
| AA122386 | 239 | collagen, type V, alpha 2 | 3.44 | up | 0.02566 |
| AA496715 | 1400 | spectrin SH3 domain binding protein 1 | 3.44 | up | 0.00069 |
| H65042 | 1975 | EST | 3.44 | up | 0.0006 |
| AA024776 | 48 | EST | 3.44 | up | 0.00334 |
| X62153 | 3751 | minichromosome maintenance deficient (*S. cerevisiae*) 3 | 3.44 | up | 0.00704 |
| D30946 | 1638 | kinesin family member 3B | 3.43 | up | 0.01458 |
| AA384184 | 774 | DKFZP586B0519 protein | 3.42 | up | 0.01222 |
| AA461282 | 1237 | dihydropyrimidinase-like 2 | 3.42 | up | 0.02014 |
| AA417884 | 919 | cyclin-dependent kinase inhibitor 2C (p18, inhibits CDK4) | 3.42 | up | 0.02997 |
| W46947 | 3530 | EST | 3.42 | up | 0.04665 |
| AA479139 | 1310 | acid phosphatase 1, soluble | 3.42 | up | 0.01853 |
| AA412301 | 899 | EST | 3.42 | up | 0.0129 |
| AA116036 | 233 | chromosome 20 open reading frame 1 | 3.41 | up | 0.00089 |
| AA370163 | 766 | EST | 3.41 | up | 0.00134 |
| AA598831 | 1440 | EST | 3.41 | up | 0.00452 |
| R31607 | 2812 | EST | 3.41 | up | 0.00163 |
| R27296 | 2806 | EST | 3.41 | up | 0.00309 |
| R52161 | 2892 | EST | 3.41 | up | 0.00053 |
| X66899 | 3769 | Ewing sarcoma breakpoint region 1 | 3.41 | up | 0.03777 |
| AA187579 | 390 | MCT-1 protein | 3.4 | up | 0.02455 |
| AA459542 | 1218 | regulatory factor X-associated ankyrin-containing protein | 3.4 | up | 0.00841 |
| AA227145 | 454 | EST | 3.4 | up | 0.03422 |
| AA406216 | 871 | EST | 3.4 | up | 0.00529 |
| AA443316 | 1075 | v-Ha-ras Harvey rat sarcoma viral oncogene homolog | 3.4 | up | 0.00133 |
| H99489 | 2078 | quiescin Q6 | 3.4 | up | 0.02682 |
| L11669 | 2157 | tetracycline transporter-like protein | 3.4 | up | 0.02062 |
| L76568 | 2225 | excision repair cross-complementing rodent repair deficiency, complementation group 4 | 3.4 | up | 0.0172 |
| AA424881 | 949 | EST | 3.39 | up | 0.03546 |
| N51855 | 2549 | ADP-ribosyltransferase (NAD+; poly (ADP-ribose) polymerase)-like 3 | 3.39 | up | 0.00115 |
| R43952 | 2852 | homeo box B5 | 3.39 | up | 0.04829 |
| T23516 | 3082 | 3-phosphoglycerate dehydrogenase | 3.39 | up | 0.00551 |
| F10290 | 1815 | EST | 3.39 | up | 0.02392 |
| H62474 | 1970 | EST | 3.39 | up | 0.04173 |
| M57730 | 2358 | ephrin-A1 | 3.39 | up | 0.00199 |
| X62534 | 3752 | high-mobility group (nonhistone chromosomal) protein 2 | 3.39 | up | 0.0186 |
| Z38444 | 3888 | KIAA0923 protein | 3.38 | up | 0.02918 |
| R70253 | 2944 | EST | 3.38 | up | 0.03125 |
| D28589 | 1637 | EST | 3.38 | up | 0.01144 |
| AA173597 | 373 | EST | 3.37 | up | 0.03622 |
| AA456583 | 1193 | PL6 protein | 3.37 | up | 0.00139 |
| AA621535 | 1527 | FE65-LIKE 2 | 3.37 | up | 0.0167 |
| AA029288 | 65 | EST | 3.36 | up | 0.04908 |
| AA207103 | 429 | EST | 3.36 | up | 0.00131 |
| AA286911 | 684 | EST | 3.36 | up | 0.00037 |
| T33625 | 3107 | EST | 3.36 | up | 0.04096 |
| AA052941 | 121 | EST | 3.36 | up | 0.00088 |
| R15740 | 2790 | carbohydrate (keratan sulfate Gal-6) sulfotransferase 1 | 3.36 | up | 0.00268 |
| T33619 | 3106 | EST | 3.36 | up | 0.01283 |
| M14483 | 2261 | prothymosin, alpha (gene sequence 28) | 3.36 | up | 0.00033 |
| AA488872 | 1363 | EST | 3.35 | up | 0.03191 |
| W80730 | 3604 | EST | 3.35 | up | 0.01526 |
| AA115562 | 229 | EST | 3.35 | up | 0.00283 |
| AA620779 | 1508 | golgin-67 | 3.35 | up | 0.00297 |
| C14835 | 1571 | EST | 3.35 | up | 0.0316 |
| AA442155 | 1068 | transforming acidic coiled-coil containing protein 3 | 3.35 | up | 0.00344 |
| AA449828 | 1130 | EST | 3.35 | up | 0.01609 |
| X69910 | 3784 | transmembrane protein (63 kD), endoplasmic reticulum/Golgi intermediate compartment | 3.35 | up | 0.00898 |
| AA421213 | 931 | Lsm3 protein | 3.34 | up | 0.00198 |
| AA456646 | 1196 | EST | 3.34 | up | 0.0309 |

TABLE 7A-continued

Up in HCC vs Normal Sample Set 2

| Fragment Name | SEQ ID: | Known Gene Name | Fold Change | Direction | Pvalue |
|---|---|---|---|---|---|
| W84447 | 3614 | EST | 3.34 | up | 0.00986 |
| AA479881 | 1317 | EST | 3.34 | up | 0.03289 |
| D51072 | 1674 | biliverdin reductase A | 3.34 | up | 0.0254 |
| U55206 | 3391 | gamma-glutamyl hydrolase (conjugase, folylpolygammaglutamyl hydrolase) | 3.34 | up | 0.00315 |
| X04347 | 3677 | heterogeneous nuclear ribonucleoprotein A1 | 3.34 | up | 0.00123 |
| AA451992 | 1140 | HSPC039 protein | 3.33 | up | 0.01696 |
| D82277 | 1743 | LDL induced EC protein | 3.33 | up | 0.00355 |
| AA426521 | 967 | Sjogren's syndrome nuclear autoantigen 1 | 3.33 | up | 0.01163 |
| AA128407 | 259 | EST | 3.33 | up | 0.02298 |
| AA046745 | 113 | Wolf-Hirschhorn syndrome candidate 1 | 3.33 | up | 0.00648 |
| AA521149 | 1420 | EST | 3.33 | up | 0.00211 |
| AA608668 | 1465 | erythrocyte membrane protein band 4.1-like 2 | 3.33 | up | 0.02014 |
| H99261 | 2074 | EST | 3.33 | up | 0.00319 |
| W63608 | 3561 | EST | 3.33 | up | 0.02443 |
| AA456415 | 1192 | KIAA0537 gene product | 3.32 | up | 0.00155 |
| AA479096 | 1308 | EST | 3.32 | up | 0.00118 |
| T97679 | 3265 | EST | 3.32 | up | 0.01566 |
| N48790 | 2531 | EST | 3.32 | up | 0.00654 |
| T81393 | 3227 | HMT1 (hnRNP methyltransferase, S. cerevisiae)-like 1 | 3.32 | up | 0.0023 |
| U73379 | 3417 | ubiquitin carrier protein E2-C | 3.32 | up | 0.00808 |
| AA071387 | 158 | jumping translocation breakpoint | 3.31 | up | 0.0001 |
| AA504413 | 1413 | EST | 3.31 | up | 0.00036 |
| AA429572 | 1000 | ribosomal protein S6 | 3.31 | up | 0.02144 |
| R49395 | 2880 | EST | 3.31 | up | 0.00867 |
| R53109 | 2898 | dimethylarginine dimethylaminohydrolase 2 | 3.31 | up | 0.02406 |
| AA485084 | 1340 | EST | 3.31 | up | 0.01232 |
| AA136864 | 304 | zinc finger protein homologous to Zfp-36 in mouse | 3.31 | up | 0.00346 |
| D31294 | 1643 | EST | 3.3 | up | 0.004 |
| AA398141 | 788 | EST | 3.3 | up | 0.00211 |
| AA465093 | 1267 | TIA1 cytotoxic granule-associated RNA-binding protein | 3.3 | up | 0.01314 |
| H16251 | 1886 | EST | 3.3 | up | 0.03286 |
| AA620761 | 1507 | EST | 3.3 | up | 0.00285 |
| AA053662 | 129 | EST | 3.3 | up | 0.00558 |
| M27830 | 2314 | EST | 3.3 | up | 0.02453 |
| AF004022 | 1546 | serine/threonine kinase 12 | 3.29 | up | 0.00841 |
| AA476944 | 1288 | EST | 3.29 | up | 0.00189 |
| AA452167 | 1142 | EST | 3.29 | up | 0.03337 |
| T17339 | 3075 | EST | 3.29 | up | 0.00669 |
| AA291644 | 701 | EST | 3.28 | up | 0.00033 |
| Z47727 | 3937 | polymerase (RNA) II (DNA directed) polypeptide K (7.0 kD) | 3.28 | up | 0.00317 |
| AA242757 | 522 | EST | 3.27 | up | 0.00286 |
| AA458890 | 1206 | EST | 3.27 | up | 0.00079 |
| R49482 | 2883 | EST | 3.27 | up | 0.0161 |
| W42778 | 3510 | EST | 3.27 | up | 0.02411 |
| AA022623 | 44 | EST | 3.27 | up | 0.01556 |
| AA435662 | 1039 | EST | 3.27 | up | 0.0433 |
| AA284565 | 675 | EST | 3.27 | up | 0.0362 |
| N34825 | 2497 | DKFZP434P106 protein | 3.27 | up | 0.01334 |
| H65030 | 1974 | phospholipase A2, group VII (platelet-activating factor acetylhydrolase, plasma) | 3.26 | up | 0.02278 |
| Z40883 | 3921 | EST | 3.26 | up | 0.01863 |
| AA621530 | 1526 | EST | 3.26 | up | 0.00298 |
| AA091752 | 193 | purine-rich element binding protein B | 3.25 | up | 0.01419 |
| AA092290 | 195 | EST | 3.25 | up | 0.01616 |
| AA478971 | 1306 | disabled (Drosophila) homolog 2 (mitogen-responsive phosphoprotein) | 3.25 | up | 0.02698 |
| AA610073 | 1497 | EST | 3.25 | up | 0.00859 |
| AA251230 | 540 | EST | 3.25 | up | 0.01417 |
| N64374 | 2607 | KIAA0537 gene product | 3.25 | up | 0.01652 |
| W69468 | 3571 | EST | 3.25 | up | 0.00055 |
| AA426374 | 964 | tubulin, alpha 2 | 3.25 | up | 0.04346 |
| D21063 | 1628 | minichromosome maintenance deficient (S. cerevisiae) 2 (mitotin) | 3.25 | up | 0.03558 |
| AA598589 | 1431 | EST | 3.24 | up | 0.00432 |
| R16144 | 2793 | EST | 3.24 | up | 0.0087 |
| AA195067 | 414 | GTPase activating protein-like | 3.24 | up | 0.00606 |
| W42788 | 3511 | deoxynucleotidyltransferase, terminal | 3.24 | up | 0.02261 |
| U90426 | 3452 | nuclear RNA helicase, DECD variant of DEAD box family | 3.24 | up | 0.00035 |
| AA279418 | 626 | EST | 3.23 | up | 0.02054 |
| F04479 | 1789 | KIAA1067 protein | 3.23 | up | 0.04522 |
| T94452 | 3256 | EST | 3.23 | up | 0.02245 |
| W47206 | 3532 | EST | 3.23 | up | 0.01931 |
| AA074162 | 159 | superkiller viralicidic activity 2 (S. cerevisiae homolog)-like | 3.23 | up | 0.00642 |
| AA406384 | 875 | KIAA0670 protein/acinus | 3.23 | up | 0.00486 |
| L06797 | 2143 | chemokine (C-X-C motif), receptor 4 (fusin) | 3.23 | up | 0.04782 |
| T99312 | 3269 | EST | 3.22 | up | 0.00084 |
| R54614 | 2901 | EST | 3.22 | up | 0.00334 |

TABLE 7A-continued

Up in HCC vs Normal Sample Set 2

| Fragment Name | SEQ ID: | Known Gene Name | Fold Change | Direction | Pvalue |
|---|---|---|---|---|---|
| D38305 | 1652 | transducer of ERBB2, 1 | 3.22 | up | 0.0215 |
| AA495857 | 1394 | EST | 3.21 | up | 0.02243 |
| W28366 | 3488 | EST | 3.21 | up | 0.01007 |
| AA465342 | 1271 | EST | 3.21 | up | 0.01378 |
| M97856 | 2435 | nuclear autoantigenic sperm protein (histone-binding) | 3.21 | up | 0.00444 |
| T10316 | 3051 | EST | 3.2 | up | 0.04794 |
| AA429470 | 996 | EST | 3.2 | up | 0.0153 |
| AA047704 | 120 | EST | 3.2 | up | 0.0029 |
| AA132514 | 272 | EST | 3.2 | up | 0.00876 |
| X14487 | 3699 | keratin 10 (epidermolytic hyperkeratosis; keratosis palmaris et plantaris) | 3.19 | up | 0.01268 |
| AA167708 | 363 | EST | 3.19 | up | 0.01871 |
| AA431719 | 1025 | EST | 3.19 | up | 0.00294 |
| AA070485 | 156 | interleukin 13 receptor, alpha 1 | 3.19 | up | 0.03465 |
| T47969 | 3127 | ceroid-lipofuscinosis, neuronal 3, juvenile (Batten, Spielmeyer-Vogt disease) | 3.19 | up | 0.02283 |
| M91083 | 2418 | chromosome 11 open reading frame 13 | 3.19 | up | 0.00243 |
| AA476754 | 1287 | EST | 3.18 | up | 0.01696 |
| AA046410 | 110 | EST | 3.18 | up | 0.00797 |
| AA131220 | 267 | EST | 3.18 | up | 0.00974 |
| H73484 | 1995 | ferritin, heavy polypeptide 1 | 3.18 | up | 0.00432 |
| M61916 | 2372 | laminin, beta 1 | 3.18 | up | 0.01171 |
| AA453628 | 1154 | EST | 3.18 | up | 0.00849 |
| AA465218 | 1268 | DKFZP586M1523 protein | 3.17 | up | 0.00357 |
| N31597 | 2486 | DKFZP564G2022 protein | 3.17 | up | 0.03017 |
| AA021549 | 42 | EST | 3.17 | up | 0.00158 |
| AA025166 | 50 | fusion, derived from t(12;16) malignant liposarcoma | 3.17 | up | 0.00009 |
| AA252524 | 555 | EST | 3.17 | up | 0.00686 |
| W46810 | 3528 | HMT1 (hnRNP methyltransferase, S. cerevisiae)-like 2 | 3.17 | up | 0.03434 |
| AA045365 | 106 | EST | 3.17 | up | 0.0149 |
| D57317 | 1688 | activated RNA polymerase II transcription cofactor 4 | 3.17 | up | 0.00464 |
| D80710 | 1734 | integral type I protein | 3.17 | up | 0.04549 |
| AA296994 | 724 | seven transmembrane domain protein | 3.16 | up | 0.0076 |
| AA256131 | 574 | glycophosphatidylinositol anchor attachment 1 | 3.16 | up | 0.00011 |
| AA282571 | 662 | FSHD region gene 1 | 3.16 | up | 0.01355 |
| AA321833 | 736 | EST | 3.16 | up | 0.00523 |
| AA430675 | 1019 | Fanconi anemia, complementation group G | 3.16 | up | 0.01007 |
| AA235853 | 503 | CGI-96 protein | 3.16 | up | 0.00744 |
| N93316 | 2732 | EST | 3.16 | up | 0.01262 |
| R51908 | 2891 | EST | 3.16 | up | 0.0083 |
| AA136474 | 301 | Meis (mouse) homolog 2 | 3.15 | up | 0.02837 |
| AA463934 | 1253 | splicing factor 3b, subunit 4, 49 kD | 3.15 | up | 0.00952 |
| W56642 | 3544 | EST | 3.15 | up | 0.00654 |
| AA070206 | 155 | EST | 3.15 | up | 0.03914 |
| AA251428 | 542 | DKFZP586I2223 protein | 3.15 | up | 0.01223 |
| AA253011 | 558 | KIAA0713 protein | 3.15 | up | 0.00035 |
| AA258387 | 594 | EST | 3.15 | up | 0.02028 |
| AA621146 | 1514 | MUF1 protein | 3.15 | up | 0.02116 |
| N69879 | 2650 | drebrin 1 | 3.15 | up | 0.01659 |
| AA047379 | 119 | karyopherin (importin) beta 1 | 3.15 | up | 0.01572 |
| AA398563 | 797 | EST | 3.14 | up | 0.01895 |
| AA478415 | 1299 | EST | 3.14 | up | 0.0483 |
| U18321 | 3317 | death associated protein 3 | 3.14 | up | 0.00833 |
| AA482319 | 1335 | putative type II membrane protein | 3.13 | up | 0.00071 |
| AA086412 | 187 | DEAD/H (Asp-Glu-Ala-Asp/His) box polypeptide 16 | 3.13 | up | 0.00327 |
| AA256268 | 576 | EST | 3.13 | up | 0.03874 |
| AA450247 | 1133 | EST | 3.13 | up | 0.00531 |
| AA621752 | 1529 | 26S proteasome-associated pad1 homolog | 3.13 | up | 0.01571 |
| D20899 | 1626 | EST | 3.13 | up | 0.02128 |
| H89987 | 2027 | ATP-binding cassette, sub-family C (CFTR/MRP), member 5 | 3.13 | up | 0.01194 |
| N90238 | 2711 | EST | 3.13 | up | 0.02492 |
| R39610 | 2837 | calpain, large polypeptide L2 | 3.13 | up | 0.01863 |
| X14850 | 3703 | H2A histone family, member X | 3.13 | up | 0.01523 |
| Y08999 | 3852 | actin related protein 2/3 complex, subunit 1A (41 kD) | 3.13 | up | 0.02376 |
| HG2994-HT4850 | | elastin (supravalvular aortic stenosis, Williams-Beuren syndrome) | 3.13 | up | 0.01206 |
| AA446570 | 1089 | EST | 3.12 | up | 0.02228 |
| D13636 | 1606 | general transcription factor IIIC, polypeptide 2 (beta subunit, 110 kD) | 3.12 | up | 0.00022 |
| L34587 | 2200 | transcription elongation factor B (SIII), polypeptide 1 (15 kD, elongin C) | 3.12 | up | 0.00946 |
| S67070 | 3022 | heat shock 27 kD protein 2 | 3.12 | up | 0.01688 |
| U59321 | 3397 | DEAD/H (Asp-Glu-Ala-Asp/His) box polypeptide 17 (72 kD) | 3.12 | up | 0.02469 |
| AA429825 | 1003 | DKFZP566B023 protein | 3.11 | up | 0.01857 |
| W49743 | 3537 | EST | 3.11 | up | 0.01121 |
| N69084 | 2642 | EST | 3.11 | up | 0.0094 |
| AA236412 | 511 | EST | 3.1 | up | 0.04463 |
| W02695 | 3466 | EST | 3.1 | up | 0.04745 |
| AA285132 | 682 | apoptotic protease activating factor | 3.1 | up | 0.00844 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA621367 | 1523 | EST | 3.1 | up | 0.00066 |
| H48459 | 1937 | KIAA0186 gene product | 3.1 | up | 0.02325 |
| N53067 | 2556 | DKFZP547E1010 protein | 3.1 | up | 0.00101 |
| X92896 | 3826 | DNA segment on chromosome X (unique) 9879 expressed sequence | 3.1 | up | 0.0405 |
| AA005262 | 13 | EST | 3.09 | up | 0.0064 |
| AA430154 | 1014 | EST | 3.09 | up | 0.04401 |
| AA433947 | 1034 | EST | 3.09 | up | 0.00253 |
| AA599808 | 1455 | EST | 3.09 | up | 0.00726 |
| Z38431 | 3886 | EST | 3.09 | up | 0.0083 |
| AA405544 | 861 | EST | 3.09 | up | 0.04146 |
| AA446970 | 1098 | EST | 3.09 | up | 0.01627 |
| D80917 | 1736 | KIAA0670 protein/acinus | 3.09 | up | 0.00168 |
| W72187 | 3579 | EST | 3.09 | up | 0.00134 |
| AA478615 | 1305 | H1 histone family, member X | 3.09 | up | 0.0499 |
| W15495 | 3473 | chromosome 21 open reading frame 5 | 3.09 | up | 0.00491 |
| W58247 | 3548 | kinesin family member 4 | 3.08 | up | 0.00048 |
| AA428204 | 987 | cofactor required for Sp1 transcriptional activation, subunit 6 (77 kD) | 3.08 | up | 0.00313 |
| AA481060 | 1326 | EST | 3.08 | up | 0.00029 |
| AA481420 | 1327 | EST | 3.08 | up | 0.0206 |
| AA505141 | 1418 | EST | 3.08 | up | 0.02327 |
| T41078 | 3120 | bromodomain adjacent to zinc finger domain, 2B | 3.08 | up | 0.03426 |
| N29484 | 2477 | EST | 3.08 | up | 0.04834 |
| R60512 | 2917 | KIAA0191 protein | 3.08 | up | 0.00856 |
| AA011679 | 32 | EST | 3.08 | up | 0.03649 |
| AA427734 | 977 | cholinergic receptor, nicotinic, epsilon polypeptide | 3.08 | up | 0.04796 |
| D86957 | 1754 | KIAA0202 protein | 3.08 | up | 0.02949 |
| M86667 | 2410 | nucleosome assembly protein 1-like 1 | 3.08 | up | 0.00473 |
| AA031814 | 70 | KIAA0958 protein | 3.07 | up | 0.00681 |
| AA236904 | 518 | EST | 3.07 | up | 0.01503 |
| D80946 | 1737 | SFRS protein kinase 1 | 3.07 | up | 0.00986 |
| W42674 | 3509 | EST | 3.07 | up | 0.0261 |
| W74536 | 3595 | advanced glycosylation end product-specific receptor | 3.07 | up | 0.00251 |
| AA435681 | 1041 | EST | 3.07 | up | 0.01166 |
| AA599469 | 1450 | EST | 3.07 | up | 0.04154 |
| D13370 | 1603 | APEX nuclease (multifunctional DNA repair enzyme) | 3.07 | up | 0.00857 |
| HG4297-HT4567 | | activated RNA polymerase II transcription cofactor 4 | 3.07 | up | 0.00787 |
| M93036 | 2421 | membrane component, chromosomal 4, surface marker (35 kD glycoprotein) | 3.07 | up | 0.04199 |
| U30825 | 3342 | splicing factor, arginine/serine-rich 9 | 3.07 | up | 0.01928 |
| H67964 | 1981 | EST | 3.06 | up | 0.02707 |
| AA194998 | 413 | purinergic receptor (family A group 5) | 3.06 | up | 0.04752 |
| AA435769 | 1046 | EST | 3.06 | up | 0.00615 |
| AA464423 | 1259 | EST | 3.06 | up | 0.01416 |
| AA251766 | 543 | EST | 3.06 | up | 0.0098 |
| AA256524 | 580 | AD022 protein | 3.06 | up | 0.00626 |
| AA412720 | 905 | EST | 3.06 | up | 0.02153 |
| H11320 | 1875 | SUMO-1 activating enzyme subunit 2 | 3.06 | up | 0.00167 |
| R28636 | 2808 | UDP-Gal:betaGlcNAc beta 1,4- galactosyltransferase, polypeptide 3 | 3.06 | up | 0.03678 |
| T40439 | 3114 | small nuclear ribonucleoprotein polypeptide B" | 3.06 | up | 0.02842 |
| X79536 | 3801 | heterogeneous nuclear ribonucleoprotein A1 | 3.06 | up | 0.00449 |
| H09241 | 1861 | EST | 3.05 | up | 0.01487 |
| AA425544 | 955 | eukaryotic translation initiation factor 2B, subunit 2 (beta, 39 kD) | 3.05 | up | 0.0346 |
| F02863 | 1782 | EST | 3.05 | up | 0.03504 |
| AA477316 | 1290 | calumenin | 3.05 | up | 0.00608 |
| W58081 | 3547 | neuroendocrine-specific protein C like (foocen) | 3.05 | up | 0.03767 |
| AA293868 | 721 | EST | 3.04 | up | 0.0054 |
| AA125808 | 240 | EST | 3.04 | up | 0.02112 |
| AA236532 | 513 | EST | 3.04 | up | 0.03747 |
| Z41747 | 3933 | succinate dehydrogenase complex, subunit A, flavoprotein (Fp) | 3.04 | up | 0.01336 |
| AA598829 | 1439 | heterogeneous nuclear ribonucleoprotein U (scaffold attachment factor A) | 3.04 | up | 0.00967 |
| Y00764 | 3848 | ubiquinol-cytochrome c reductase hinge protein | 3.04 | up | 0.01294 |
| N42272 | 2514 | EST | 3.03 | up | 0.0017 |
| AA284720 | 676 | EST | 3.03 | up | 0.00252 |
| R46079 | 2867 | EST | 3.03 | up | 0.00755 |
| H96850 | 2055 | dolichyl-diphosphooligosaccharide-protein glycosyltransferase | 3.03 | up | 0.00679 |
| AA426291 | 961 | EST | 3.03 | up | 0.00365 |
| H99364 | 2075 | chloride channel 7 | 3.03 | up | 0.01727 |
| R06400 | 2767 | EST | 3.03 | up | 0.03266 |
| R20817 | 2796 | ubiquitin-conjugating enzyme E2A (RAD6 homolog) | 3.03 | up | 0.01091 |
| D86977 | 1757 | KIAA0224 gene product | 3.03 | up | 0.00053 |
| AA442400 | 1071 | hepatitis B virus x-interacting protein (9.6 kD) | 3.02 | up | 0.04037 |
| AA055892 | 134 | EST | 3.02 | up | 0.04984 |
| W04507 | 3468 | prefoldin 4 | 3.02 | up | 0.04091 |
| Z38904 | 3893 | EST | 3.02 | up | 0.00814 |
| AA252355 | 553 | EST | 3.02 | up | 0.00715 |

TABLE 7A-continued

Up in HCC vs Normal Sample Set 2

| Fragment Name | SEQ ID: | Known Gene Name | Fold Change | Direction | Pvalue |
|---|---|---|---|---|---|
| AA293589 | 719 | zinc finger protein | 3.02 | up | 0.01809 |
| AA453656 | 1155 | EST | 3.02 | up | 0.00958 |
| U68142 | 3410 | RAB2, member RAS oncogene family-like | 3.02 | up | 0.0296 |
| U90904 | 3457 | EST | 3.02 | up | 0.00381 |
| J04029 | 2102 | keratin 10 (epidermolytic hyperkeratosis; keratosis palmaris et plantaris) | 3.02 | up | 0.00032 |
| AA598749 | 1438 | EST | 3.01 | up | 0.03714 |
| F10741 | 1822 | KIAA0622 protein | 3.01 | up | 0.03079 |
| AA365708 | 764 | microfibrillar-associated protein 1 | 3.01 | up | 0.02372 |
| AA426447 | 965 | EST | 3.01 | up | 0.02414 |
| W57931 | 3546 | EST | 3.01 | up | 0.02661 |
| AA181580 | 383 | karyopherin (importin) beta 1 | 3.01 | up | 0.0125 |
| H27897 | 1911 | hypothetical protein | 3.01 | up | 0.00174 |
| N51590 | 2545 | EST | 3.01 | up | 0.04345 |
| R46337 | 2868 | secretory carrier membrane protein 3 | 3.01 | up | 0.00374 |
| T66935 | 3178 | EST | 3.01 | up | 0.00123 |
| AA173505 | 372 | EST | 3 | up | 0.01736 |
| AA476473 | 1285 | EST | 3 | up | 0.01324 |
| AA448252 | 1114 | EST | 3 | up | 0.00256 |
| W95841 | 3663 | EST | 3 | up | 0.00466 |

TABLE 7B

Down in HCC 2 vs Normal Sample Set 2

| Fragment Name | SEQ ID: | Known Gene Name | Fold Change | Direction | Pvalue |
|---|---|---|---|---|---|
| H81070 | 2006 | RNA helicase-related protein | 39.64 | down | 0.00002 |
| AA007395 | 17 | alcohol dehydrogenase 4 (class II), pi polypeptide | 37.78 | down | 0.00939 |
| T68711 | 3187 | EST | 35.98 | down | 0.0003 |
| T48075 | 3129 | hemoglobin, alpha 1 | 35.75 | down | 0.00471 |
| N80129 | 2702 | metallothionein 1L | 26.87 | down | 0.00999 |
| AA010605 | 26 | 4-hydroxyphenylpyruvate dioxygenase | 25.52 | down | 0.00855 |
| W88946 | 3636 | putative glycine-N-acyltransferase | 25.28 | down | 0.00221 |
| T48278 | 3131 | EST | 24.1 | down | 0.00595 |
| T95813 | 3261 | KIAA1051 protein | 20.36 | down | 0.01361 |
| H58692 | 1960 | formyltetrahydrofolate dehydrogenase | 20.18 | down | 0.00485 |
| R97419 | 3003 | cytochrome P450, subfamily VIIIB (sterol 12-alpha-hydroxylase), polypeptide 1 | 19.3 | down | 0.00807 |
| H80901 | 2005 | ficolin (collagen/fibrinogen domain-containing) 3 (Hakata antigen) | 18.59 | down | 0 |
| J03910 | 2101 | EST | 18.13 | down | 0.00119 |
| M29873 | 2318 | cytochrome P450, subfamily IIB (phenobarbital-inducible) | 17.92 | down | 0.01469 |
| U56814 | 3392 | deoxyribonuclease I-like 3 | 17.69 | down | 0.00007 |
| T67931 | 3183 | fibrinogen, B beta polypeptide | 17.25 | down | 0.00128 |
| T58756 | 3155 | EST | 16.61 | down | 0 |
| R49602 | 2884 | EST | 16.17 | down | 0.00279 |
| T69305 | 3196 | EST | 15.87 | down | 0.02258 |
| Z20777 | 3863 | EST | 15.73 | down | 0.00147 |
| H58673 | 1959 | EST | 15.49 | down | 0.00002 |
| T56281 | 3150 | RNA helicase-related protein | 14.64 | down | 0.00027 |
| K03192 | 2127 | cytochrome P450, subfamily IIA (phenobarbital-inducible), polypeptide 6 | 14.19 | down | 0.0307 |
| AA448002 | 1113 | putative type II membrane protein | 14.14 | down | 0 |
| T68873 | 3189 | metallothionein 1L | 13.68 | down | 0.00593 |
| R89811 | 2979 | HGF activator | 13.29 | down | 0.00148 |
| M14777 | 2263 | glutathione S-transferase A2, glutathione S-transferase A3 | 13.23 | down | 0.03224 |
| D31628 | 1646 | 4-hydroxyphenylpyruvate dioxygenase | 13.18 | down | 0.02064 |
| H20543 | 1897 | DKFZP586B1621 protein | 13.06 | down | 0.00218 |
| W81552 | 3612 | EST | 12.97 | down | 0.00244 |
| N54053 | 2560 | secreted phosphoprotein 2, 24 kD | 12.87 | down | 0.01821 |
| R40395 | 2840 | lecithin-cholesterol acyltransferase | 12.85 | down | 0.01334 |
| H08102 | 1858 | breast cell glutaminase | 12.85 | down | 0.0424 |
| AA455988 | 1184 | butyrobetaine (gamma), 2-oxoglutarate dioxygenase (gamma-butyrobetaine hydroxylase) | 12.51 | down | 0 |
| R12472 | 2788 | EST | 12.09 | down | 0.02379 |
| U22029 | 3326 | cytochrome P450, subfamily IIA (phenobarbital-inducible), polypeptide 7 | 11.85 | down | 0.03538 |

TABLE 7B-continued

Down in HCC 2 vs Normal Sample Set 2

| Fragment Name | SEQ ID: | Known Gene Name | Fold Change | Direction | Pvalue |
|---|---|---|---|---|---|
| AA446864 | 1095 | EST | 11.57 | down | 0.0001 |
| N80129 | 2702 | metallothionein 1L | 11.48 | down | 0.00167 |
| M33317 | 2338 | cytochrome P450, subfamily IIA (phenobarbital-inducible), polypeptide 7 fatty-acid-Coenzyme A ligase, long-chain 1, fatty-acid-Coenzyme A ligase, | 11.47 | down | 0.02611 |
| AA348922 | 758 | long-chain 2 | 11.4 | down | 0.00848 |
| T98676 | 3268 | EST | 11.15 | down | 0.0323 |
| M81349 | 2404 | serum amyloid A4, constitutive | 10.97 | down | 0.01946 |
| AA074885 | 161 | macrophage receptor with collagenous structure | 10.88 | down | 0.00087 |
| M16974 | 2277 | complement component 8, alpha polypeptide | 10.85 | down | 0.02313 |
| N70966 | 2662 | solute carrier family 10 (sodium/bile acid cotransporter family), member 1 | 10.8 | down | 0.02894 |
| AA279676 | 630 | deoxyribonuclease I-like 3 | 10.52 | down | 0.00181 |
| N68596 | 2635 | betaine-homocysteine methyltransferase | 10.46 | down | 0.01971 |
| AA433946 | 1033 | EST | 10.24 | down | 0.00663 |
| W72382 | 3581 | oxidative 3 alpha hydroxysteroid dehydrogenase; retinol dehydrogenase | 9.89 | down | 0.03091 |
| X56411 | 3734 | alcohol dehydrogenase 4 (class II), pi polypeptide | 9.87 | down | 0.01416 |
| D00003 | 1586 | cytochrome P450, subfamily IIIA (niphedipine oxidase), polypeptide 3 | 9.46 | down | 0.00001 |
| AA448300 | 1116 | FXYD domain-containing ion transport regulator 1 (phospholemman) | 9.27 | down | 0.00108 |
| H77597 | 2000 | metallothionein 1H | 9.01 | down | 0.00022 |
| HG1428-HT1428 | | hemoglobin, beta | 8.98 | down | 0.02071 |
| R08564 | 2779 | plasminogen-like | 8.77 | down | 0.01284 |
| T51150 | 3136 | EST | 8.65 | down | 0.00553 |
| H93381 | 2036 | EST | 8.62 | down | 0.01271 |
| N58009 | 2577 | formiminotransferase cyclodeaminase | 8.52 | down | 0.01808 |
| AA417046 | 915 | fatty-acid-Coenzyme A ligase, very long-chain 1 | 8.49 | down | 0.02476 |
| T57140 | 3151 | paraoxonase 3 | 8.47 | down | 0.01048 |
| N70358 | 2656 | growth hormone receptor | 8.47 | down | 0.00816 |
| AA256367 | 579 | paraoxonase 3 | 8.37 | down | 0.02326 |
| R98073 | 3008 | EST | 8.37 | down | 0.01436 |
| N74025 | 2684 | deiodinase, iodothyronine, type I | 8.18 | down | 0.01363 |
| N51117 | 2543 | EST | 8.17 | down | 0.00105 |
| M29874 | 2319 | cytochrome P450, subfamily IIB (phenobarbital-inducible) | 8.13 | down | 0.01064 |
| L04751 | 2138 | cytochrome P450, subfamily IVA, polypeptide 11 | 8.13 | down | 0.02065 |
| X13930 | 3697 | cytochrome P450, subfamily IIA (phenobarbital-inducible), polypeptide 6 | 8.1 | down | 0.0219 |
| U50929 | 3379 | betaine-homocysteine methyltransferase | 8.04 | down | 0.0188 |
| Z28339 | 3872 | aldo-keto reductase family 1, member D1 (delta 4-3-ketosteroid-5-beta-reductase) | 8.03 | down | 0.00853 |
| T83397 | 3232 | phytanoyl-CoA hydroxylase (Refsum disease) | 8.03 | down | 0.02173 |
| K03192 | 2127 | cytochrome P450, subfamily IIA (phenobarbital-inducible), polypeptide 6 | 8.02 | down | 0.03483 |
| AA401562 | 830 | EST | 7.97 | down | 0.00527 |
| AA035245 | 79 | aldehyde oxidase 1 | 7.79 | down | 0.02387 |
| M94065 | 2424 | dihydroorotate dehydrogenase | 7.87 | down | 0.0011 |
| AA453988 | 1160 | methionine adenosyltransferase I, alpha | 7.78 | down | 0.02695 |
| X54380 | 3727 | pregnancy-zone protein | 7.71 | down | 0.00069 |
| H57060 | 1954 | EST | 7.57 | down | 0.00875 |
| R99591 | 3015 | CD5 antigen-like (scavenger receptor cysteine rich family) | 7.41 | down | 0.00043 |
| Z84721 | 3950 | hemoglobin, zeta | 7.39 | down | 0.01921 |
| D14012 | 1612 | HGF activator | 7.27 | down | 0.00145 |
| Z49269 | 3942 | small inducible cytokine subfamily A (Cys-Cys), member 14 | 7.24 | down | 0.01047 |
| T74542 | 3214 | UDP glycosyltransferase 2 family, polypeptide B10 | 7.19 | down | 0.011 |
| AA235310 | 496 | EST | 7.08 | down | 0.04056 |
| R73816 | 2960 | EST | 7.05 | down | 0.01287 |
| AA287566 | 690 | KIAA0187 gene product | 6.99 | down | 0.00023 |
| N51773 | 2548 | EST | 6.92 | down | 0.01839 |
| W28944 | 3493 | EST | 6.9 | down | 0.01014 |
| N54429 | 2567 | EST | 6.85 | down | 0.03334 |
| N63845 | 2604 | phytanoyl-CoA hydroxylase (Refsum disease) | 6.82 | down | 0.00369 |
| D00003 | 1586 | cytochrome P450, subfamily IIIA (niphedipine oxidase), polypeptide 3 | 6.8 | down | 0.01328 |
| AA236455 | 512 | EST | 6.73 | down | 0.02418 |
| K02402 | 2125 | coagulation factor IX (plasma thromboplastic component, Christmas disease, hemophilia B) | 6.64 | down | 0.04082 |
| H59136 | 1962 | EST | 6.63 | down | 0.00033 |
| AA057678 | 143 | EST | 6.63 | down | 0.00089 |
| X16349 | 3709 | sex hormone-binding globulin | 6.61 | down | 0.00008 |

TABLE 7B-continued

Down in HCC 2 vs Normal Sample Set 2

| Fragment Name | SEQ ID: | Known Gene Name | Fold Change | Direction | Pvalue |
|---|---|---|---|---|---|
| R65593 | 2934 | kynurenine 3-monooxygenase (kynurenine 3-hydroxylase) | 6.6 | down | 0.01982 |
| AA099225 | 206 | EST | 6.59 | down | 0.00064 |
| N54950 | 2572 | ketohexokinase (fructokinase) | 6.47 | down | 0.0223 |
| N54417 | 2566 | fibrinogen, A alpha polypeptide | 6.47 | down | 0.00733 |
| R92475 | 2986 | flavin containing monooxygenase 3 | 6.46 | down | 0.02269 |
| R69417 | 2941 | EST | 6.43 | down | 0.00778 |
| R40492 | 2841 | EST | 6.4 | down | 0.00527 |
| U06641 | 3286 | UDP glycosyltransferase 2 family, polypeptide B15 | 6.37 | down | 0.01594 |
| AA599937 | 1458 | insulin-like growth factor-binding protein 4 | 6.31 | down | 0.0477 |
| T63364 | 3169 | ficolin (collagen/fibrinogen domain-containing) 3 (Hakata antigen) | 6.27 | down | 0.00455 |
| AA490620 | 1378 | EST | 6.25 | down | 0.03613 |
| R59722 | 2915 | EST | 6.24 | down | 0.02361 |
| M10943 | 2234 | metallothionein 1F (functional) | 6.23 | down | 0.00007 |
| X95190 | 3829 | acyl-Coenzyme A oxidase 2, branched chain | 6.22 | down | 0.00162 |
| AA232114 | 463 | epoxide hydrolase 2, cytoplasmic | 6.18 | down | 0.00231 |
| J02843 | 2088 | cytochrome P450, subfamily IIE (ethanol-inducible) | 6.18 | down | 0.01308 |
| AA150776 | 330 | EST | 6.17 | down | 0.00004 |
| T51617 | 3137 | solute carrier family 22 (extraneuronal monoamine transporter), member 3 | 6.16 | down | 0.04198 |
| N64036 | 2606 | enoyl-Coenzyme A, hydratase/3-hydroxyacyl Coenzyme A dehydrogenase | 6.12 | down | 0.00476 |
| T74608 | 3215 | hydroxyacid oxidase (glycolate oxidase) 1 | 6.1 | down | 0.00249 |
| M76665 | 2397 | hydroxysteroid (11-beta) dehydrogenase 1 | 6.06 | down | 0.01317 |
| L12760 | 2162 | phosphoenolpyruvate carboxykinase 1 (soluble) | 6.06 | down | 0.01005 |
| W86075 | 3621 | EST | 6.04 | down | 0.01486 |
| D12620 | 1601 | cytochrome P450, subfamily IVF, polypeptide 2, cytochrome P450, subfamily IVE, polypeptide 3 (leukotriene B4 omega hydroxylase) | 6.03 | down | 0.03947 |
| M83652 | 2407 | properdin P factor, complement | 6 | down | 0.00002 |
| D62518 | 1708 | EST | 5.96 | down | 0.00027 |
| L16883 | 2166 | cytochrome P450, subfamily IIC (mephenytoin 4-hydroxylase), polypeptide 9 | 5.85 | down | 0.04368 |
| AA233152 | 467 | EST | 5.8 | down | 0.00272 |
| AA343142 | 751 | EST | 5.79 | down | 0.02747 |
| U56814 | 3392 | deoxyribonuclease I-like 3 | 5.75 | down | 0.00152 |
| T78433 | 3219 | glycogen synthase 2 (liver) | 5.74 | down | 0.00949 |
| AA454733 | 1169 | EST | 5.73 | down | 0.00748 |
| AA010205 | 23 | EST | 5.71 | down | 0.00014 |
| AA284795 | 678 | phosphatidylethanolamine N-methyltransferase | 5.7 | down | 0.00004 |
| N31741 | 2488 | serine hydroxymethyltransferase 1 (soluble) | 5.66 | down | 0.00212 |
| X76717 | 3794 | metallothionein 1L | 5.64 | down | 0.00215 |
| W55903 | 3543 | adipose differentiation-related protein; adipophilin | 5.64 | down | 0.00014 |
| AA253369 | 563 | EST | 5.64 | down | 0.00478 |
| D13243 | 1602 | pyruvate kinase, liver and RBC | 5.58 | down | 0.04029 |
| AA007629 | 19 | EST | 5.56 | down | 0.00005 |
| R93776 | 2992 | EST | 5.55 | down | 0.00084 |
| D78011 | 1717 | dihydropyrimidinase | 5.54 | down | 0.0312 |
| AA005358 | 14 | EST | 5.51 | down | 0.00059 |
| R77628 | 2965 | insulin induced gene 1 | 5.51 | down | 0.0404 |
| W87532 | 3631 | putative glycine-N-acyltransferase | 5.5 | down | 0.00739 |
| AA460661 | 1229 | EST | 5.46 | down | 0.00151 |
| M16594 | 2272 | glutathione S-transferase A2 | 5.42 | down | 0.03813 |
| T52813 | 3141 | putative lymphocyte G0/G1 switch gene | 5.4 | down | 0.02021 |
| L32140 | 2192 | afamin | 5.39 | down | 0.02767 |
| AA039335 | 89 | coagulation factor XII (Hageman factor) | 5.33 | down | 0.03807 |
| U20530 | 3321 | secreted phosphoprotein 2, 24 kD | 5.31 | down | 0.01119 |
| AA236401 | 510 | EST | 5.31 | down | 0.01787 |
| AA478298 | 1297 | adipose specific 2 | 5.29 | down | 0.00943 |
| AA010619 | 27 | EST | 5.28 | down | 0.002 |
| AA609519 | 1482 | EST | 5.23 | down | 0.00068 |
| L21893 | 2176 | solute carrier family 10 (sodium/bile acid cotransporter family), member 1 | 5.23 | down | 0.03367 |
| AA287122 | 686 | EST | 5.21 | down | 0.00523 |
| AA608837 | 1472 | EST | 5.15 | down | 0.00005 |
| M83772 | 2408 | flavin containing monooxygenase 3 | 5.14 | down | 0.02023 |
| S70004 | 3028 | glycogen synthase 2 (liver) | 5.13 | down | 0.00183 |
| AA172372 | 370 | EST | 5.12 | down | 0.00032 |
| AA090439 | 192 | ribosomal protein S6 | 5.11 | down | 0.01108 |
| AA236455 | 512 | EST | 5.1 | down | 0.00307 |
| J04449 | 2110 | cytochrome P450, subfamily IIIA (niphedipine oxidase), polypeptide 3 | 5.07 | down | 0.01733 |
| AA291749 | 703 | estrogen receptor 1 | 5.06 | down | 0.00044 |
| S68287 | 3024 | aldo-keto reductase family 1, member C4 | 5.04 | down | 0.02895 |

TABLE 7B-continued

Down in HCC 2 vs Normal Sample Set 2

| Fragment Name | SEQ ID: | Known Gene Name | Fold Change | Direction | Pvalue |
|---|---|---|---|---|---|
| | | (chlordecone reductase; 3-alpha hydroxysteroid dehydrogenase, type I; dihydrodiol dehydrogenase 4) | | | |
| AA458652 | 1202 | EST | 5.03 | down | 0.00065 |
| K02766 | 2126 | complement component 9 | 5.03 | down | 0.0433 |
| AA297532 | 725 | EST | 5.01 | down | 0.00745 |
| H29568 | 1914 | EST | 5 | down | 0.00426 |
| AA285053 | 681 | EST | 5 | down | 0.00718 |
| Z40902 | 3923 | SEC14 (*S. cerevisiae*)-like 2 | 4.97 | down | 0.04672 |
| T72906 | 3209 | EST | 4.91 | down | 0.00512 |
| N22938 | 2452 | serum amyloid A4, constitutive | 4.91 | down | 0.01918 |
| R79750 | 2970 | EST | 4.89 | down | 0.00695 |
| AA609537 | 1483 | hepatic leukemia factor | 4.88 | down | 0.00118 |
| N57464 | 2575 | CCAAT/enhancer binding protein (C/EBP), delta | 4.87 | down | 0.00111 |
| AA196287 | 420 | EST | 4.86 | down | 0.01656 |
| J05428 | 2120 | UDP glycosyltransferase 2 family, polypeptide B7 | 4.86 | down | 0.03414 |
| D49357 | 1665 | methionine adenosyltransferase I, alpha | 4.85 | down | 0.04435 |
| R40899 | 2843 | glycine receptor, beta | 4.84 | down | 0.02369 |
| AA480991 | 1323 | EST | 4.83 | down | 0.03498 |
| M99439 | 2437 | transducin-like enhancer of split 4, homolog of Drosophila E(sp1) | 4.82 | down | 0.00121 |
| X06562 | 3683 | growth hormone receptor | 4.8 | down | 0.00507 |
| AA426640 | 969 | small inducible cytokine subfamily B (Cys-X-Cys), member 14 (BRAK) | 4.8 | down | 0.00539 |
| AA194997 | 412 | EST | 4.8 | down | 0.00153 |
| N39201 | 2509 | protease inhibitor 4 (kallistatin) | 4.79 | down | 0.02015 |
| T16484 | 3070 | EST | 4.78 | down | 0.00009 |
| N59550 | 2587 | EST | 4.78 | down | 0.02924 |
| AA046747 | 114 | EST | 4.77 | down | 0.00023 |
| T72502 | 3207 | EST | 4.74 | down | 0.00404 |
| AA085987 | 183 | UDP glycosyltransferase 1 | 4.74 | down | 0.03035 |
| D12620 | 1601 | cytochrome P450, subfamily IVF, polypeptide 2, cytochrome P450, subfamily IVF, polypeptide 3 (leukotriene B4 omega hydroxylase) | 4.7 | down | 0.04091 |
| U51010 | 3380 | nicotinamide N-methyltransferase | 4.69 | down | 0.03099 |
| N67105 | 2623 | EST | 4.69 | down | 0.00194 |
| R93714 | 2991 | fetuin B | 4.65 | down | 0.03704 |
| AA076383 | 171 | EST | 4.65 | down | 0.00593 |
| N73543 | 2674 | EST | 4.64 | down | 0.03981 |
| Y00317 | 3842 | UDP glycosyltransferase 2 family, polypeptide B4 | 4.63 | down | 0.02986 |
| U95090 | 3463 | nephrosis 1, congenital, Finnish type (nephrin) | 4.63 | down | 0.01595 |
| T40936 | 3117 | EST | 4.62 | down | 0.02844 |
| AA477119 | 1289 | EST | 4.62 | down | 0.00072 |
| HG2841-HT2968 | | albumin | 4.62 | down | 0.00552 |
| AA377087 | 771 | EST | 4.61 | down | 0.01616 |
| Z48475 | 3940 | glucokinase (hexokinase 4) regulatory protein | 4.6 | down | 0.01693 |
| R94674 | 2995 | EST | 4.58 | down | 0.0047 |
| N52322 | 2552 | EST | 4.58 | down | 0.02077 |
| AA621131 | 1513 | EST | 4.57 | down | 0.03867 |
| R01023 | 2751 | glucokinase (hexokinase 4) regulatory protein | 4.56 | down | 0.04036 |
| L09229 | 2150 | fatty-acid-Coenzyme A ligase, long-chain 1, fatty-acid-Coenzyme A ligase, long-chain 2 | 4.5 | down | 0.01347 |
| N29764 | 2481 | EST | 4.48 | down | 0.013 |
| Z40259 | 3916 | EST | 4.47 | down | 0.00093 |
| M31667 | 2331 | cytochrome P450, subfamily I (aromatic compound-inducible), polypeptide 2 | 4.47 | down | 0.01116 |
| W26996 | 3483 | EST | 4.46 | down | 0.00734 |
| U02388 | 3277 | cytochrome P450, subfamily IVF, polypeptide 2 | 4.4 | down | 0.00761 |
| W67147 | 3565 | deleted in liver cancer 1 | 4.37 | down | 0.00069 |
| H55759 | 1949 | EST | 4.36 | down | 0.0398 |
| AA112101 | 222 | EST | 4.36 | down | 0.03175 |
| D79276 | 1722 | succinate-CoA ligase, GDP-forming, beta subunit | 4.34 | down | 0.00836 |
| R66002 | 2935 | EST | 4.33 | down | 0.00789 |
| N66066 | 2612 | EST | 4.33 | down | 0.0184 |
| AA398892 | 800 | similar to yeast BET3 (*S. cerevisiae*) | 4.33 | down | 0.01326 |
| C20653 | 1578 | EST | 4.32 | down | 0.00718 |
| R22905 | 2800 | EST | 4.31 | down | 0.01744 |
| M25079 | 2305 | hemoglobin, beta | 4.31 | down | 0.01567 |
| N39163 | 2508 | metallothionein 1L | 4.3 | down | 0.03917 |
| M26393 | 2309 | acyl-Coenzyme A dehydrogenase, C-2 to C-3 short chain | 4.3 | down | 0.02294 |
| H02855 | 1832 | EST | 4.29 | down | 0.0138 |
| X90579 | 3816 | EST | 4.26 | down | 0.04759 |
| X63359 | 3756 | UDP glycosyltransferase 2 family, polypeptide B10 | 4.26 | down | 0.01725 |
| X72177 | 3787 | complement component 6 | 4.25 | down | 0.01598 |
| W95041 | 3659 | EST | 4.22 | down | 0.01005 |

TABLE 7B-continued

Down in HCC 2 vs Normal Sample Set 2

| Fragment Name | SEQ ID: | Known Gene Name | Fold Change | Direction | Pvalue |
|---|---|---|---|---|---|
| AA223902 | 450 | EST | 4.22 | down | 0.01315 |
| AA435746 | 1043 | GTPase activating protein-like | 4.21 | down | 0.03192 |
| T68878 | 3190 | carboxylesterase 1 (monocyte/macrophage serine esterase 1) | 4.18 | down | 0.02474 |
| AA100026 | 211 | EST | 4.18 | down | 0.00567 |
| L27050 | 2186 | apolipoprotein F | 4.18 | down | 0.04901 |
| D10040 | 1593 | fatty-acid-Coenzyme A ligase, long-chain 2 | 4.15 | down | 0.02947 |
| AA253216 | 561 | EST | 4.14 | down | 0.0014 |
| H93246 | 2035 | EST | 4.14 | down | 0.00058 |
| AA258350 | 592 | EST | 4.1 | down | 0.02962 |
| X58022 | 3744 | corticotropin releasing hormone-binding protein | 4.09 | down | 0.00076 |
| Z40305 | 3917 | EST | 4.09 | down | 0.00096 |
| AA599814 | 1456 | EST | 4.09 | down | 0.00235 |
| AA428325 | 988 | EST | 4.09 | down | 0.02486 |
| T61649 | 3164 | superoxide dismutase 2, mitochondrial | 4.08 | down | 0.0389 |
| D11756 | 1596 | EST | 4.08 | down | 0.02972 |
| N77326 | 2695 | EST | 4.08 | down | 0.00768 |
| X67491 | 3773 | glutamate dehydrogenase 1 | 4.06 | down | 0.00273 |
| W28414 | 3489 | EST | 4.06 | down | 0.00083 |
| T98199 | 3266 | EST | 4.05 | down | 0.00753 |
| M10942 | 2233 | metallothionein 1E (functional) | 4.05 | down | 0.01412 |
| H06935 | 1855 | electron-transferring-flavoprotein dehydrogenase | 4.04 | down | 0.01498 |
| AA129390 | 262 | EST | 4.03 | down | 0.00128 |
| W87781 | 3633 | EST | 4.02 | down | 0.00284 |
| AA621209 | 1516 | similar to Caenorhabditis elegans protein C42C1.9 | 4.01 | down | 0.00563 |
| L05144 | 2139 | phosphoenolpyruvate carboxykinase 1 (soluble) | 4 | down | 0.021 |
| N34804 | 2496 | DKFZP434J214 protein | 3.97 | down | 0.0175 |
| U08006 | 3289 | complement component 8, alpha polypeptide | 3.96 | down | 0.04272 |
| Z69923 | 3945 | HGF activator | 3.95 | down | 0.00012 |
| H87765 | 2017 | KIAA0626 gene product | 3.94 | down | 0.00123 |
| R43799 | 2850 | EST | 3.93 | down | 0.005 |
| C02460 | 1562 | EST | 3.92 | down | 0.03073 |
| H99727 | 2080 | adipose differentiation-related protein; adipophilin | 3.91 | down | 0.00325 |
| AA486511 | 1349 | EST | 3.9 | down | 0.01409 |
| AA477919 | 1293 | EST | 3.9 | down | 0.00265 |
| M63967 | 2378 | aldehyde dehydrogenase 5 | 3.88 | down | 0.00274 |
| W44745 | 3517 | EST | 3.87 | down | 0.01051 |
| N63391 | 2599 | EST | 3.87 | down | 0.02935 |
| L00389 | 2132 | cytochrome P450, subfamily I (aromatic compound-inducible), polypeptide 2 | 3.87 | down | 0.00844 |
| W63728 | 3562 | EST | 3.86 | down | 0.00288 |
| AA435985 | 1049 | EST | 3.86 | down | 0.01713 |
| AA151676 | 337 | peptidyl arginine deiminase, type II | 3.85 | down | 0.00875 |
| AA076326 | 170 | SEC14 (S. cerevisiae)-like 2 | 3.85 | down | 0.0349 |
| X02176 | 3669 | complement component 9 | 3.84 | down | 0.01793 |
| AA039616 | 90 | EST | 3.84 | down | 0.00997 |
| HG2730-HT2827 | | fibrinogen, A alpha polypeptide | 3.84 | down | 0.00795 |
| H66367 | 1977 | EST | 3.84 | down | 0.00133 |
| M30185 | 2321 | cholesteryl ester transfer protein, plasma | 3.82 | down | 0.00131 |
| AA167565 | 362 | EST | 3.81 | down | 0.04057 |
| HG2379-HT3996 | | serine hydroxymethyltransferase 1 (soluble) | 3.81 | down | 0.01837 |
| D90042 | 1767 | N-acetyltransferase 2 (arylamine N-acetyltransferase) | 3.79 | down | 0.00697 |
| X16260 | 3707 | inter-alpha (globulin) inhibitor, H1 polypeptide | 3.76 | down | 0.00291 |
| AA122345 | 238 | glutamate dehydrogenase 1 | 3.75 | down | 0.01058 |
| M86826 | 2412 | insulin-like growth factor binding protein, acid labile subunit | 3.75 | down | 0.01157 |
| L11931 | 2159 | serine hydroxymethyltransferase 1 (soluble) | 3.74 | down | 0.0056 |
| AA460012 | 1224 | solute carrier family 22 (extraneuronal monoamine transporter), member 3 | 3.73 | down | 0.0313 |
| X97324 | 3836 | adipose differentiation-related protein; adipophilin | 3.72 | down | 0.00202 |
| D63160 | 1709 | ficolin (collagen/fibrinogen domain-containing lectin) 2 (hucolin) | 3.72 | down | 0.00312 |
| W86600 | 3625 | EST | 3.67 | down | 0.04208 |
| N52271 | 2551 | LIM protein (similar to rat protein kinase C-binding enigma) | 3.67 | down | 0.01102 |
| AA402224 | 836 | growth arrest and DNA-damage-inducible, gamma | 3.66 | down | 0.0033 |
| N91087 | 2716 | EST | 3.66 | down | 0.00725 |
| C02386 | 1561 | hypothetical protein | 3.66 | down | 0.00673 |
| U27699 | 3339 | solute carrier family 6 (neurotransmitter transporter, betaine/GABA), member 12 | 3.65 | down | 0.00381 |
| U08021 | 3290 | nicotinamide N-methyltransferase | 3.63 | down | 0.03762 |
| HG2730-HT2828 | | fibrinogen, A alpha polypeptide | 3.62 | down | 0.01013 |
| R80048 | 2971 | EST | 3.61 | down | 0.01209 |

TABLE 7B-continued

Down in HCC 2 vs Normal Sample Set 2

| Fragment Name | SEQ ID: | Known Gene Name | Fold Change | Direction | Pvalue |
|---|---|---|---|---|---|
| M94065 | 2424 | dihydroorotate dehydrogenase | 3.61 | down | 0.00229 |
| J03810 | 2099 | solute carrier family 2 (facilitated glucose transporter), member 2 | 3.6 | down | 0.02376 |
| D00408 | 1589 | cytochrome P450, subfamily IIIA (niphedipine oxidase), polypeptide 3, cytochrome P450, subfamily IIIA (niphedipine oxidase), polypeptide 5, cytochrome P450, subfamily IIIA, polypeptide 7 | 3.58 | down | 0.02048 |
| C20810 | 1579 | EST | 3.57 | down | 0.02116 |
| T61256 | 3161 | ketohexokinase (fructokinase) | 3.56 | down | 0.04957 |
| AA164586 | 359 | estrogen receptor 1 | 3.56 | down | 0.01231 |
| S77356 | 3033 | EST | 3.55 | down | 0.03874 |
| X14813 | 3702 | acetyl-Coenzyme A acyltransferase 1 (peroxisomal 3-oxoacyl-Coenzyme A thiolase) | 3.53 | down | 0.00059 |
| AA460449 | 1228 | EST | 3.53 | down | 0.01247 |
| N99542 | 2746 | orosomucoid 1 | 3.53 | down | 0.00607 |
| W07723 | 3470 | EST | 3.51 | down | 0.00026 |
| F02245 | 1776 | monoamine oxidase A | 3.51 | down | 0.01692 |
| AA182030 | 387 | EST | 3.51 | down | 0.0403 |
| W45560 | 3522 | EST | 3.48 | down | 0.0179 |
| W73818 | 3590 | EST | 3.47 | down | 0.00927 |
| AA455367 | 1176 | DKFZP586F1018 protein | 3.47 | down | 0.00138 |
| T87174 | 3239 | EST | 3.46 | down | 0.00026 |
| AA282061 | 652 | KIAA0962 protein | 3.46 | down | 0.00698 |
| AA233837 | 474 | EST | 3.46 | down | 0.01365 |
| W73601 | 3589 | EST | 3.45 | down | 0.01382 |
| R09053 | 2782 | EST | 3.45 | down | 0.03074 |
| AA142849 | 306 | EST | 3.45 | down | 0.03495 |
| M61854 | 2370 | cytochrome P450, subfamily IIC (mephenytoin 4-hydroxylase) | 3.45 | down | 0.02949 |
| AA376875 | 770 | monoamine oxidase A | 3.45 | down | 0.00105 |
| N29353 | 2476 | kynurenine 3-monooxygenase (kynurenine 3-hydroxylase) | 3.44 | down | 0.01212 |
| N22404 | 2449 | EST | 3.44 | down | 0.02267 |
| AA608802 | 1470 | EST | 3.44 | down | 0.01709 |
| T40995 | 3118 | alcohol dehydrogenase 3 (class I), gamma polypeptide | 3.42 | down | 0.00957 |
| AA035457 | 80 | EST | 3.41 | down | 0.00968 |
| AA401376 | 829 | EST | 3.39 | down | 0.01403 |
| AA018922 | 40 | core promoter element binding protein | 3.39 | down | 0.01801 |
| N65959 | 2611 | EST | 3.38 | down | 0.00785 |
| AA188921 | 393 | similar to Caenorhabditis elegans protein C42C1.9 | 3.38 | down | 0.00862 |
| Z41042 | 3925 | EST | 3.37 | down | 0.00703 |
| H27330 | 1909 | EST | 3.37 | down | 0.01318 |
| AA450127 | 1132 | growth arrest and DNA-damage-inducible, beta | 3.37 | down | 0.00647 |
| J05158 | 2117 | carboxypeptidase N, polypeptide 2, 83 kD | 3.37 | down | 0.01156 |
| N90584 | 2713 | EST | 3.36 | down | 0.01561 |
| F03969 | 1785 | matrix metalloproteinase 2 (gelatinase A, 72 kD gelatinase, 72 kD type IV collagenase) | 3.36 | down | 0.01685 |
| M95585 | 2429 | hepatic leukemia factor | 3.36 | down | 0.00492 |
| HG4533-HT4938 | | protease inhibitor 4 (kallistatin) | 3.35 | down | 0.01605 |
| X06985 | 3686 | heme oxygenase (decycling) 1 | 3.34 | down | 0.00045 |
| H66840 | 1978 | EST | 3.34 | down | 0.01884 |
| M72885 | 2392 | putative lymphocyte G0/G1 switch gene | 3.34 | down | 0.02943 |
| W28798 | 3491 | phosphodiesterase 6A, cGMP-specific, rod, alpha | 3.33 | down | 0.00222 |
| T47778 | 3126 | fibrinogen, A alpha polypeptide | 3.33 | down | 0.00637 |
| AA599472 | 1451 | succinate-CoA ligase, GDP-forming, beta subunit | 3.31 | down | 0.02619 |
| AA084668 | 180 | ubiquitin-like 3 | 3.31 | down | 0.02055 |
| M30185 | 2321 | cholesteryl ester transfer protein, plasma | 3.31 | down | 0.00109 |
| L00352 | 2131 | low density lipoprotein receptor (familial hypercholesterolemia) | 3.3 | down | 0.03487 |
| D13705 | 1610 | cytochrome P450, subfamily IVA, polypeptide 11 | 3.3 | down | 0.0051 |
| Z31690 | 3878 | lipase A, lysosomal acid, cholesterol esterase (Wolman disease) | 3.29 | down | 0.00161 |
| AA450114 | 1131 | EST | 3.29 | down | 0.01171 |
| AA282886 | 663 | EST | 3.29 | down | 0.00025 |
| AA397841 | 780 | EST | 3.29 | down | 0.00825 |
| N57934 | 2576 | formiminotransferase cyclodeaminase | 3.28 | down | 0.01555 |
| J04093 | 2106 | UDP glycosyltransferase 1 | 3.28 | down | 0.02286 |
| X64177 | 3760 | metallothionein 1H | 3.26 | down | 0.03928 |
| T10264 | 3050 | EST | 3.26 | down | 0.01718 |
| C21130 | 1583 | EST | 3.24 | down | 0.03355 |
| AA070191 | 154 | EST | 3.24 | down | 0.00216 |
| H62212 | 1969 | telomeric repeat binding factor 2 | 3.23 | down | 0.00513 |
| X13227 | 3695 | D-amino-acid oxidase | 3.22 | down | 0.01753 |
| Z80345 | 3948 | acyl-Coenzyme A dehydrogenase, C-2 to C-3 short chain | 3.21 | down | 0.04734 |

TABLE 7B-continued

Down in HCC 2 vs Normal Sample Set 2

| Fragment Name | SEQ ID: | Known Gene Name | Fold Change | Direction | Pvalue |
|---|---|---|---|---|---|
| M68895 | | alcohol dehydrogenase 6 (class V) | 3.21 | down | 0.02095 |
| AA400177 | 808 | EST | 3.21 | down | 0.03901 |
| H09317 | 1864 | EST | 3.2 | down | 0.00914 |
| T68510 | 3186 | EST | 3.19 | down | 0.01504 |
| AA465233 | 1269 | succinate-CoA ligase, GDP-forming, beta subunit | 3.19 | down | 0.00036 |
| AA461444 | 1239 | EST | 3.19 | down | 0.02844 |
| AA147646 | 317 | DKFZP586A0522 protein | 3.19 | down | 0.00508 |
| D78725 | 1720 | KIAA0914 gene product | 3.19 | down | 0.01083 |
| U65932 | 3404 | extracellular matrix protein 1 | 3.18 | down | 0.00575 |
| U21931 | 3325 | fructose-bisphosphatase 1 | 3.17 | down | 0.0143 |
| T64575 | 3171 | EST | 3.16 | down | 0.01855 |
| M57731 | 2359 | GRO2 oncogene | 3.16 | down | 0.02204 |
| F02028 | 1774 | EST | 3.15 | down | 0.00902 |
| T41232 | 3121 | EST | 3.14 | down | 0.02012 |
| AA210850 | 431 | EST | 3.12 | down | 0.00288 |
| W72044 | 3577 | insulin induced gene 1 | 3.1 | down | 0.03445 |
| M68840 | 2388 | monoamine oxidase A | 3.1 | down | 0.01953 |
| H57816 | 1957 | EST | 3.09 | down | 0.01327 |
| H10779 | 1872 | methylenetetrahydrofolate dehydrogenase (NADP + dependent). methenyltetrahydrofolate cyclohydrolase, formyltetrahydrofolate synthetase | 3.09 | down | 0.0496 |
| M93405 | 2423 | methylmalonate-semialdehyde dehydrogenase | 3.09 | down | 0.03285 |
| T41047 | 3119 | EST | 3.08 | down | 0.00553 |
| AA157799 | 348 | aldo-keto reductase family 7, member A2 (aflatoxin aldehyde reductase) | 3.08 | down | 0.00207 |
| M34276 | 2341 | plasminogen | 3.08 | down | 0.02754 |
| H05704 | 1848 | EST | 3.07 | down | 0.00363 |
| AA069696 | 150 | EST | 3.07 | down | 0.01569 |
| M16750 | 2273 | pim-1 oncogene | 3.07 | down | 0.02391 |
| AA056482 | 141 | EST | 3.06 | down | 0.01313 |
| AA046457 | 111 | EST | 3.05 | down | 0.02078 |
| M13143 | 2249 | kallikrein B plasma, (Fletcher factor) 1 | 3.04 | down | 0.008 |
| U50196 | 3376 | adenosine kinase | 3.03 | down | 0.00975 |
| AA090257 | 190 | superoxide dismutase 2, mitochondrial | 3.03 | down | 0.02774 |
| N49902 | 2539 | EST | 3.02 | down | 0.00951 |
| AA442334 | 1069 | EST | 3.02 | down | 0.01936 |
| D45529 | 1662 | EST | 3.01 | down | 0.03105 |
| AA404487 | 851 | EST | 3.01 | down | 0.0059 |

TABLE 8A

Genes and ESTs expressed only in HCC2 vs Normal2

| Fragment Name | SEQ ID: | Known Gene Name | fold change in hcc set 2 | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| AA093497 | 199 | DEK oncogene (DNA binding) | #N/A | #N/A | 180.58 | 107.64 | 165.71 | 52.11 | 48.84 | 26.51 |
| AA248283 | 534 | EST | #N/A | #N/A | 67.18 | 45.86 | 55.18 | 21.63 | 18.96 | 11.71 |
| AA291456 | 700 | EST | #N/A | #N/A | 828.34 | 830.24 | 196.63 | 671.21 | 509.58 | 629.13 |
| AA400643 | 817 | GAS2-related on chromosome 22 | 4.04 | 0.03751 | 118.72 | 123.18 | 137.15 | -43.6 | -33.96 | 60.39 |
| AA421079 | 930 | EST | #N/A | #N/A | 37.17 | 34.26 | 18.5 | 15.27 | 16.75 | 15.28 |
| AA428172 | 986 | Notch (Drosophila) homolog 3 | 9.63 | 0.00195 | 335.57 | 374.9 | 231.52 | -9.64 | -15.61 | 56.16 |
| AA464043 | 1255 | EST | 3.99 | 0.00056 | 116.97 | 115.99 | 53.49 | 14.27 | 10.06 | 25.86 |
| H19562 | 1896 | PTD010 protein | #N/A | #N/A | 522.13 | 432.65 | 256.94 | 393.61 | 326.53 | 182.71 |
| L08044 | 2149 | trefoil factor 3 (intestinal) | #N/A | #N/A | 214.6 | 108.17 | 238.79 | 107.82 | 58.55 | 184.16 |
| L29218 | 2190 | CDC-like kinase 2 | 6.51 | 0.00019 | 219.64 | 237.35 | 104.29 | 6.53 | -10.03 | 59.8 |
| L37747 | 2206 | lamin B1 | #N/A | #N/A | 43.42 | 28.65 | 37.33 | 5.97 | 5.1 | 7.57 |
| N34257 | 2494 | EST | #N/A | #N/A | 20.76 | 21.48 | 19.54 | -1.84 | -2.74 | 8.53 |
| R50692 | 2887 | KIAA0476 gene product | #N/A | #N/A | 197.89 | 187.87 | 101.08 | 148.53 | 151.12 | 63.03 |
| R60368 | 2916 | EST | #N/A | #N/A | 29.68 | 28.93 | 31.9 | -28.29 | -26.44 | 41.68 |
| R66475 | 2937 | EST | #N/A | #N/A | 45.68 | 32.34 | 34.37 | 7.64 | 8.26 | 6.3 |
| T34377 | 3110 | potassium voltage-gated channel, shaker-related subfamily, beta member 2 | 4.55 | 0.00041 | 113.59 | 120.58 | 51.65 | 6.87 | 11.17 | 25.69 |
| U75968 | 3422 | DEAD/H (Asp-Glu-Ala-Asp/His) box polypeptide 11 (S.cerevisiae CHL1-like helicase) | #N/A | #N/A | 187.33 | 200.16 | 90.35 | 115.5 | 102.24 | 77.72 |
| W21426 | 3480 | KIAA0806 gene product | #N/A | #N/A | 63.36 | 64.93 | 20.23 | 45.59 | 40.39 | 19.89 |
| W28696 | 3490 | EST | #N/A | #N/A | 14.7 | 20.64 | 17.12 | 4.28 | 4.33 | 2.47 |
| X57129 | 3740 | H1 histone family, member 2 | 4.63 | 0.00663 | 137.13 | 137.75 | 87.31 | 8.38 | 5.39 | 28.3 |
| AA024658 | 47 | ribosomal protein S19 | 7.55 | 0.00592 | 278.11 | 120.83 | 373.3 | 7.62 | 5.03 | 10.68 |
| AA029288 | 65 | EST | 3.36 | 0.04908 | 134.53 | 56.15 | 209.69 | 4.09 | 3.35 | 8.39 |
| AA037828 | 88 | KIAA0614 protein | #N/A | #N/A | 53.61 | 46.86 | 41.68 | 13.32 | 10.65 | 11.96 |
| AA040465 | 95 | EST | 3.63 | 0.01806 | 229.8 | 210.67 | 180.94 | 47.15 | 45.53 | 5.48 |
| AA053660 | 128 | EST | #N/A | #N/A | 543.66 | 223.47 | 685.44 | 95.24 | 79.97 | 42.99 |
| AA136332 | 299 | cAMP responsive element binding protein 3 (luman) | #N/A | #N/A | 49.04 | 33.07 | 31.07 | -18.27 | -20.23 | 13.05 |
| AA149530 | 324 | interferon regulatory factor 3 | #N/A | #N/A | 32.94 | 23.12 | 34.23 | 4.21 | 5.38 | 8.53 |
| AA149586 | 325 | EST | #N/A | #N/A | 24.99 | 26.6 | 34.37 | 5.26 | 9.11 | 23.41 |
| AA206023 | 427 | EST | #N/A | #N/A | 154.13 | 170.36 | 85.33 | 108.57 | 111.76 | 58.39 |
| AA234530 | 484 | N-ethylmaleimide-sensitive factor | #N/A | #N/A | 143.67 | 135.48 | 82.59 | 51.33 | 42.9 | 35.02 |
| AA251909 | 549 | EST | 3.59 | 0.01129 | 92.19 | 79.34 | 72.73 | 8.88 | 11.22 | 8.27 |
| AA262030 | 605 | EST | #N/A | #N/A | 119.75 | 89.66 | 103.84 | 31.51 | 32.91 | 14.46 |
| AA262477 | 608 | ribonuclease H1, large subunit | 4.57 | 0.00724 | 242.42 | 199.5 | 182.26 | 44.51 | 36.87 | 22.37 |
| AA283759 | 671 | EST | #N/A | #N/A | 91.82 | 76.73 | 42.28 | 46.87 | 45.86 | 21.54 |
| AA291644 | 701 | EST | 3.28 | 0.00033 | 114.73 | 117.29 | 44.59 | 32.77 | 30.24 | 21.1 |
| AA338760 | 744 | EST | 3.96 | 0.01307 | 129.77 | 130.26 | 87.27 | 14.91 | 21.91 | 26.96 |
| AA398205 | 789 | EST | 4.22 | 0.00059 | 125.4 | 107.84 | 63.85 | 15.01 | 7.37 | 26.26 |
| AA401965 | 833 | tumor suppressor deleted in oral cancer-related 1 | 7.58 | 0.00089 | 932.74 | 924.02 | 593.69 | 120.58 | 93.29 | 109.41 |
| AA402272 | 837 | EST | 3.73 | 0.02336 | 348.91 | 340 | 230.15 | 99.7 | 92.28 | 80.27 |
| AA404597 | 854 | EST | #N/A | #N/A | 609.98 | 525.02 | 371.31 | 379.26 | 336.33 | 167.43 |

TABLE 8A-continued

Genes and ESTs expressed only in HCC2 vs Normal2

| Fragment Name | SEQ ID: | Known Gene Name | fold change in hcc set 2 | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| AA417030 | 914 | EST | 7.35 | 0.00555 | 200.3 | 168.21 | 135.63 | 6.42 | 7.5 | 7.77 |
| AA423820 | 940 | EST | #N/A | #N/A | 111.38 | 111.23 | 120.84 | 41.9 | 21.93 | 44.58 |
| AA425852 | 958 | EST | 3.82 | 0.0395 | 131.52 | 95.35 | 166.76 | 7.02 | 5.22 | 4.75 |
| AA430032 | 1009 | pituitary tumor-transforming 1 | 10.67 | 0.00052 | 377.69 | 320.44 | 294.49 | 26.8 | 15.31 | 35.24 |
| AA430673 | 1017 | EST | #N/A | #N/A | 45.74 | 34.15 | 44.8 | -1.21 | 3.63 | 15.26 |
| AA443321 | 1076 | EST | #N/A | #N/A | 33.93 | 32.89 | 11.76 | 10.79 | 9.65 | 7.26 |
| AA443941 | 1085 | tumor suppressing subtransferable candidate 1 | #N/A | #N/A | 97.74 | 103.38 | 47.48 | 31.09 | 34.9 | 16.61 |
| AA447223 | 1100 | EST | #N/A | #N/A | 31.66 | 18.91 | 31.1 | 4.45 | 3.74 | 6.5 |
| AA449431 | 1124 | translation initiation factor IF2 | 3.76 | 0.00571 | 94.41 | 95.64 | 54.08 | 17.4 | 16.96 | 5.38 |
| AA454597 | 1166 | EST | 4.23 | 0.00917 | 342.59 | 311.81 | 207.71 | 66.6 | 57.29 | 23.41 |
| AA458882 | 1205 | EST | #N/A | #N/A | 93.56 | 52.28 | 98.72 | 24.97 | 22.52 | 17.66 |
| AA458934 | 1208 | EST | #N/A | #N/A | 33.6 | 28.19 | 29.02 | 7.1 | 7.91 | 4.22 |
| AA465342 | 1271 | EST | 3.21 | 0.01378 | 131.07 | 109.99 | 95.4 | 30.07 | 33.06 | 23.97 |
| AA477561 | 1292 | EST | #N/A | #N/A | 146.3 | 127.03 | 97.99 | 63.83 | 76.56 | 37.87 |
| AA491295 | 1390 | calcium/calmodulin-dependent protein kinase kinase 2, beta | 3.71 | 0.0103 | 180.61 | 173.47 | 118.85 | 46.95 | 31.51 | 65.56 |
| AA608545 | 1462 | RAD51 (S. cerevisiae) homolog (E. coli RecA homolog) | #N/A | #N/A | 70.5 | 57.51 | 53.36 | 7.76 | 8.92 | 6.17 |
| AA620553 | 1504 | flap structure-specific endonuclease 1 | 7.56 | 0.00101 | 262.87 | 232.63 | 201.66 | 14.44 | 4.85 | 38.53 |
| AA621325 | 1522 | HNK-1 sulfotransferase | #N/A | #N/A | 74.57 | 70.64 | 46.61 | 27.23 | 25.89 | 16.03 |
| AA621780 | 1530 | CGI-96 protein | #N/A | #N/A | 81.72 | 92.23 | 49.69 | 12.06 | 11.27 | 19.2 |
| F02807 | 1781 | KIAA0838 protein | 5.67 | 0.02064 | 260.02 | 219.01 | 229.96 | 20.93 | 16.66 | 22.24 |
| F04444 | 1788 | EST | 4.13 | 0.00944 | 371.21 | 360.5 | 186.45 | 119.68 | 121.27 | 109.82 |
| F04524 | 1790 | stomatin-like protein 1 | #N/A | #N/A | 117.77 | 135.65 | 68.29 | 46.56 | 44.53 | 33.75 |
| F08876 | 1797 | EST | 9.06 | 0 | 209.64 | 201.85 | 53.21 | -22.5 | -20.17 | 37.21 |
| F10161 | 1811 | EST | #N/A | #N/A | 50.78 | 46.73 | 32.42 | 15.4 | 14.78 | 11.87 |
| F10453 | 1819 | EST | 3.64 | 0.01878 | 135.07 | 138.53 | 85.7 | 27.28 | 14.2 | 54.04 |
| H04649 | 1838 | EST | #N/A | #N/A | 180.25 | 158.18 | 164.34 | 50.86 | 41.2 | 33.9 |
| H04793 | 1840 | DKFZP434F091 protein | #N/A | #N/A | 23.18 | 20 | 41.25 | -14.45 | -20.45 | 29 |
| H59617 | 1964 | EST | 5.81 | 0.0115 | 212.68 | 209.19 | 157.42 | 19.24 | 21.65 | 16.88 |
| H97012 | 2058 | EST | 3.51 | 0.03505 | 171.34 | 138.12 | 170.68 | 27.69 | 38.46 | 36.08 |
| H98657 | 2068 | EST | #N/A | #N/A | 141.17 | 131.42 | 69.63 | 111.2 | 84.74 | 128.92 |
| N23319 | 2453 | EST | #N/A | #N/A | 70.62 | 66.39 | 49.4 | 13.74 | 8.56 | 21.62 |
| N23868 | 2458 | EST | #N/A | #N/A | 79.69 | 81.67 | 56.06 | 20.52 | 20.19 | 11.48 |
| N45224 | 2515 | EST | #N/A | #N/A | 349.73 | 360.67 | 164.87 | 215.49 | 223.16 | 151.06 |
| N48595 | 2527 | EST | #N/A | #N/A | 85.77 | 67.62 | 51.78 | 28.84 | 29.38 | 8.3 |
| N75541 | 2691 | EST | 4.43 | 0.01059 | 182.83 | 131.35 | 183.41 | 34.1 | 15.82 | 56.07 |
| N90273 | 2712 | ras homolog gene family, member H | #N/A | #N/A | 105.53 | 96.01 | 41.89 | 68.92 | 59.56 | 35.69 |
| N93465 | 2734 | EST | #N/A | #N/A | 803.68 | 716.56 | 385.5 | 624.57 | 694.14 | 306.11 |
| R39191 | 2833 | KIAA1020 protein | 5.18 | 0.03185 | 331.72 | 80.62 | 590.96 | 17.46 | 18.33 | 16.04 |
| R44793 | 2858 | EST | 5.4 | 0.00329 | 155.86 | 121.83 | 125.26 | 10.1 | 7.86 | 16.54 |
| R44817 | 2859 | EST | #N/A | #N/A | 594.46 | 602.82 | 206.15 | 255.91 | 249.29 | 69.09 |
| R44896 | 2861 | KIAA0665 gene product | #N/A | #N/A | 67.08 | 57.13 | 34.18 | 19.1 | 20.75 | 23.04 |
| R64137 | 2930 | EST | #N/A | #N/A | 31.25 | 24.23 | 21 | 2.9 | 2.65 | 6.94 |
| R71395 | 2951 | EST | 4.12 | 0.03719 | 166.03 | 99.42 | 190.98 | 14.99 | 12.28 | 14.58 |

TABLE 8A-continued

Genes and ESTs expressed only in HCC2 vs Normal2

| Fragment Name | SEQ ID: | Known Gene Name | fold change in hcc set 2 | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| R72087 | 2954 | EST | #N/A | #N/A | 262.11 | 302.11 | 95 | 201.97 | 183.76 | 83.41 |
| R91819 | 2983 | EST | 12.81 | 0.00037 | 467.79 | 364.2 | 426.16 | 11.34 | 9.35 | 36.49 |
| T03749 | 3047 | KIAA1089 protein | 4.23 | 0.00776 | 103 | 97.55 | 74.34 | -5.18 | -6.08 | 13.69 |
| T25744 | 3091 | EST | #N/A | #N/A | 72.74 | 73.3 | 37.84 | 15.56 | 12.65 | 13.18 |
| T62918 | 3168 | EST | 5.25 | 0.00687 | 136.22 | 142.37 | 83.63 | -12.41 | -6.89 | 17.59 |
| T89731 | 3244 | EST | #N/A | #N/A | 63.59 | 65.07 | 20.47 | 5.75 | 3.83 | 11.8 |
| W32176 | 3497 | zinc metalloproteinase, STE24 (yeast, homolog) | #N/A | #N/A | 550.53 | 614.92 | 234.79 | 290.18 | 277.95 | 129.45 |
| W47388 | 3533 | rab6 GTPase activating protein (GAP and centrosome-associated) | #N/A | #N/A | 97.33 | 71 | 59.73 | 43.93 | 36.52 | 48.34 |
| W78057 | 3597 | EST | 5.53 | 0.01231 | 265.23 | 222.35 | 199.24 | 29.21 | 29.9 | 34.33 |
| W80763 | 3605 | EST | 4.98 | 0.01026 | 147.37 | 138.37 | 122.38 | 16.84 | 15.48 | 9.22 |
| W90146 | 3641 | EST | 3.58 | 0.00322 | 82.11 | 69.02 | 47.2 | 9.93 | 8.63 | 6.49 |
| Z38299 | 3884 | EST | 3.71 | 0.0036 | 140.86 | 127.16 | 96.62 | 30.48 | 25.94 | 23.34 |
| Z38404 | 3885 | EST | #N/A | #N/A | 59.77 | 56.71 | 37.29 | 29.82 | 30.16 | 9 |
| Z38462 | 3889 | KIAA0938 protein | 4.69 | 0.0142 | 137.19 | 116.11 | 116.16 | -0.86 | 0.53 | 7.64 |
| Z38688 | 3890 | EST | #N/A | #N/A | 49.85 | 46.83 | 42.25 | 21.38 | 13.4 | 29.47 |
| Z38729 | 3891 | EST | #N/A | #N/A | 77.67 | 57.81 | 60.7 | -2.4 | -5.01 | 46.96 |
| Z40556 | 3918 | CGI-96 protein | 3.17 | 0.00158 | 176.19 | 76.96 | 285.02 | 59.62 | 55.07 | 16.66 |
| AA021549 | 42 | EST | #N/A | #N/A | 100.01 | 83.02 | 44.39 | 31.74 | 20.12 | 36.74 |
| AA026670 | 56 | tyrosyl-tRNA synthetase | #N/A | #N/A | 269.96 | 261.31 | 191.51 | 76.85 | 76.68 | 45.22 |
| AA055896 | 135 | collagen, type V, alpha 1 | 10.87 | 0.00907 | 414.16 | 454.82 | 330.75 | -3.14 | -5.8 | 33.88 |
| AA112979 | 225 | vaccinia related kinase 1 | #N/A | #N/A | 37.93 | 31.05 | 16.86 | 8.54 | 8.02 | 2.59 |
| AA134063 | 286 | EST | #N/A | #N/A | 25.71 | 13.84 | 34.35 | -5.21 | -6.17 | 6 |
| AA150053 | 327 | EST | #N/A | #N/A | 270.14 | 248.87 | 144.92 | 101.87 | 88.37 | 73.73 |
| AA206914 | 428 | EST | #N/A | #N/A | 89.35 | 94.1 | 46.27 | 66.34 | 69.2 | 26.35 |
| AA243133 | 525 | serine/threonine kinase 15 | 7.03 | 0.00005 | 147.5 | 162.28 | 43.03 | 9.69 | 12.1 | 9.8 |
| AA243466 | 527 | EST | #N/A | #N/A | 61.94 | 42.38 | 37.6 | 13.66 | 13.42 | 9.63 |
| AA243598 | 531 | EST | #N/A | #N/A | 60.15 | 62.79 | 32.67 | 11.41 | 13.18 | 13.43 |
| AA252147 | 551 | EST | #N/A | #N/A | 95.91 | 56.69 | 122.31 | 3.65 | -0.82 | 22.5 |
| AA255566 | 570 | EST | #N/A | #N/A | 64.28 | 50.15 | 52.25 | 16.18 | 14.38 | 13.17 |
| AA279667 | 629 | EST | #N/A | #N/A | 184.99 | 102.43 | 289.71 | 8.06 | 7.61 | 23.78 |
| AA279943 | 635 | EST | #N/A | #N/A | 137.05 | 63.54 | 232.2 | -4.7 | -5.33 | 11.18 |
| AA290594 | 691 | EST | #N/A | #N/A | 59.19 | 56.31 | 23.84 | 21.4 | 18.8 | 23.98 |
| AA290776 | 693 | EST | #N/A | #N/A | 524.07 | 516.6 | 88.67 | 441.83 | 355.04 | 245.84 |
| AA292765 | 712 | ZW10 interactor | 7.24 | 0.00498 | 202.52 | 192.15 | 142.78 | 11.33 | 18.29 | 13.27 |
| AA398908 | 801 | EST | 20.72 | 0.00114 | 629.56 | 433.87 | 551.97 | -174.29 | -216.08 | 104.42 |
| AA405098 | 855 | EST | 6.09 | 0.01224 | 221.56 | 130.95 | 237.73 | -4.35 | -8.44 | 30.78 |
| AA406542 | 878 | EST | #N/A | #N/A | 179.08 | 84.98 | 218.93 | -1.99 | 1.49 | 12.75 |
| AA435738 | 1042 | EST | #N/A | #N/A | 80.97 | 82 | 30.96 | 50.41 | 51.29 | 33.08 |
| AA443585 | 1077 | EST | #N/A | #N/A | 200.3 | 136.72 | 140.42 | 118.18 | 97.38 | 102.71 |
| AA446596 | 1092 | Ts translation elongation factor, mitochondrial | #N/A | #N/A | 103.35 | 97.42 | 153.31 | 72.58 | 70.64 | 154.24 |
| AA447777 | 1107 | EST | #N/A | #N/A | 258.37 | 212.57 | 171.93 | 133.78 | 116.63 | 56.34 |
| AA453757 | 1156 | EST | #N/A | #N/A | 128.41 | 118.8 | 40.54 | 65.66 | 70.33 | 40.45 |
| AA459254 | 1211 | EST | 6.22 | 0.00001 | 309.74 | 308.36 | 112.62 | 51.84 | 43.51 | 37.57 |

TABLE 8A-continued

Genes and ESTs expressed only in HCC2 vs Normal2

| Fragment Name | SEQ ID: | Known Gene Name | fold change in hcc set 2 | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| AA459673 | 1220 | chromosome-associated polypeptide C | #N/A | #N/A | 32.11 | 31.27 | 15.41 | 8.91 | 6.74 | 8.86 |
| AA476333 | 1282 | EST | #N/A | #N/A | 52.26 | 34.54 | 55.5 | 9.04 | 14.67 | 24.04 |
| AA496993 | 1405 | EST | #N/A | #N/A | 91.01 | 73.62 | 80.93 | 24.83 | 12.83 | 29.07 |
| AA504512 | 1415 | KIAA0943 protein | 5.72 | 0.00384 | 316.32 | 322.55 | 180.22 | 65.48 | 28.37 | 93.94 |
| AA609132 | 1479 | EST | #N/A | #N/A | 67.33 | 42.61 | 65.11 | 29.14 | 23.25 | 53.79 |
| AA609942 | 1494 | EST | #N/A | #N/A | 89.98 | 66.8 | 71.4 | 15.89 | 14.41 | 25.58 |
| F02254 | 1777 | Fas-activated serine/threonine kinase | 5.1 | 0.00329 | 376.8 | 341.06 | 145.28 | 90 | 72.97 | 135.39 |
| H48459 | 1937 | KIAA0186 gene product | 3.1 | 0.02325 | 71.21 | 49.95 | 87.89 | −29.4 | −30.17 | 6.19 |
| H87790 | 2018 | EST | #N/A | #N/A | 284.91 | 287.54 | 145.66 | 466.07 | 547.34 | 192.71 |
| N34017 | 2493 | EST | #N/A | #N/A | 39.35 | 37.49 | 4.67 | 5.47 | 7.05 | 10.01 |
| N35493 | 2501 | EST | #N/A | #N/A | 73.6 | 80.62 | 31.24 | 19.03 | 18.75 | 17 |
| N63604 | 2600 | EST | #N/A | #N/A | 47.18 | 32.72 | 35 | 16.51 | 14.36 | 10.5 |
| N63646 | 2601 | EST | #N/A | #N/A | 479.9 | 367.24 | 240.56 | 182.22 | 137.95 | 90.9 |
| N69014 | 2641 | SRY (sex-determining region Y)-box 22 | #N/A | #N/A | 193.21 | 174.83 | 48.23 | 116.34 | 129.47 | 50.74 |
| N69879 | 2650 | drebrin 1 | 3.15 | 0.01659 | 88.78 | 84.86 | 61.76 | 3.69 | −2.94 | 21.49 |
| N69983 | 2651 | EST | #N/A | #N/A | 93.25 | 96.86 | 49.82 | 76.2 | 93.14 | 54.92 |
| N70330 | 2655 | EST | #N/A | #N/A | 108.39 | 69.74 | 105.54 | 33.78 | 27.33 | 16.47 |
| N74018 | 2683 | EST | #N/A | #N/A | 22.65 | 25.34 | 10.26 | 2.34 | 1.47 | 10.41 |
| N89670 | 2708 | EST | #N/A | #N/A | 65.03 | 59.18 | 66.58 | 3.16 | −1.81 | 43.32 |
| N93000 | 2726 | EST | #N/A | #N/A | 77.68 | 64.15 | 45.06 | 17.65 | 18.66 | 10.91 |
| N99944 | 2748 | EST | 3.46 | 0.00104 | 211.02 | 200.61 | 102.49 | 60.05 | 50.12 | 29.73 |
| R97176 | 3001 | EST | #N/A | #N/A | 143.07 | 152.08 | 86.96 | 53.41 | 58.26 | 38.91 |
| T16226 | 3065 | EST | 7.23 | 0.00119 | 323.53 | 312.1 | 209.59 | 33.87 | 22.78 | 38.68 |
| T32108 | 3102 | EST | #N/A | #N/A | 180.81 | 165.53 | 68.41 | 148.09 | 152.11 | 92.06 |
| W15275 | 3471 | EST | #N/A | #N/A | 33.62 | 31.78 | 35.23 | 30.09 | 24.85 | 43.25 |
| W31906 | 3496 | secretagogin | 6.62 | 0.00926 | 474.89 | 174.52 | 605.68 | 42.41 | 30.95 | 47.65 |
| W46286 | 3523 | EST | 3.68 | 0.00311 | 154.73 | 166.08 | 72.64 | 23.51 | 22.85 | 61.89 |
| W60097 | 3553 | DEAD/H (Asp-Glu-Ala-Asp/His) box polypeptide, Y chromosome | 4.82 | 0.04903 | 235.42 | 265.15 | 189.13 | 35.34 | 11.72 | 84.5 |
| W80852 | 3606 | KDEL (Lys-Asp-Glu-Leu) endoplasmic reticulum protein retention receptor 3 | 6.37 | 0.00005 | 184.61 | 159.98 | 100.74 | 11.16 | 11.92 | 36.06 |
| AA046745 | 113 | Wolf-Hirschhorn syndrome candidate 1 | 3.33 | 0.00648 | 73.04 | 72.71 | 48.97 | 10.59 | 12.02 | 7.33 |
| AA052941 | 121 | EST | 3.36 | 0.00088 | 100.81 | 106.86 | 44.56 | 25.66 | 25.65 | 13.62 |
| AA058589 | 144 | EST | #N/A | #N/A | 44.63 | 51.66 | 34.1 | −9.37 | −10.9 | 8.66 |
| AA126561 | 249 | EST | #N/A | #N/A | 51.44 | 44.19 | 31.6 | 7.16 | 7.73 | 8.55 |
| AA146849 | 313 | target of myb1 (chicken) homolog | 4.72 | 0.00326 | 398.05 | 341.23 | 244.73 | 98.86 | 106.97 | 86.19 |
| AA149889 | 326 | neighbor of A-kinase anchoring protein 95 | 8.55 | 0.00224 | 240.81 | 312.86 | 143.89 | −0.24 | 8.25 | 29.83 |
| AA283711 | 669 | ubiquitin carrier protein | #N/A | #N/A | 382.91 | 380.33 | 210.95 | 221.7 | 203.51 | 93.54 |
| AA284153 | 673 | EST | #N/A | #N/A | 117.98 | 127.81 | 72.86 | 53.98 | 43.58 | 32.17 |
| AA335191 | 741 | creatine kinase, brain | 6.47 | 0.01462 | 512.64 | 199.99 | 673.92 | 43.84 | 33.21 | 43.52 |
| AA402642 | 840 | TNF receptor-associated factor 1 | #N/A | #N/A | 137.67 | 59.13 | 211.07 | 35.93 | 19.15 | 31.32 |
| AA427460 | 972 | ATP-binding cassette, sub-family F (GCN20), member 2 | #N/A | #N/A | 190.92 | 187.57 | 78.83 | 92.5 | 83.63 | 49.3 |
| AA431429 | 1021 | EST | #N/A | #N/A | 25.39 | 21.98 | 9.32 | 5.32 | 4.23 | 4.43 |
| AA443316 | 1075 | v-Ha-ras Harvey rat sarcoma viral oncogene homolog | 3.4 | 0.00133 | 138.89 | 124.06 | 70.22 | 40.07 | 41.12 | 32.54 |

TABLE 8A-continued

Genes and ESTs expressed only in HCC2 vs Normal2

| Fragment Name | SEQ ID: | Known Gene Name | fold change in hcc set 2 | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| AA476260 | 1280 | EST | #N/A | #N/A | 61.23 | 69.49 | 40.45 | −32.66 | −15.85 | 56.91 |
| AA487058 | 1352 | ubiquitin-conjugating enzyme E2L 3 | #N/A | #N/A | 245.56 | 225.48 | 137.4 | 315.7 | 232.85 | 213.47 |
| AA521149 | 1420 | EST | 3.33 | 0.00211 | 113.43 | 106.74 | 60.79 | 28.44 | 29.54 | 18.61 |
| AA599244 | 1448 | KIAA0530 protein | #N/A | #N/A | 53.83 | 48.84 | 25.7 | 7.71 | 6.06 | 7.11 |
| AA599850 | 1457 | EST | 3.55 | 0.03215 | 122.91 | 75.32 | 123.52 | −1.23 | −2.33 | 31.86 |
| AA621530 | 1526 | EST | 3.26 | 0.00298 | 78.73 | 75.43 | 40.45 | 12.46 | 15.12 | 13.43 |
| AA621644 | 1528 | EST | #N/A | #N/A | 83.13 | 88.29 | 43.19 | 71.19 | 66.84 | 29.87 |
| C15078 | 1573 | EST | #N/A | #N/A | 121.71 | 98.25 | 100.16 | 26.22 | 31.14 | 60.2 |
| D80710 | 1734 | integral type I protein | 3.17 | 0.04549 | 153.76 | 74.74 | 166.28 | 22.95 | 28.29 | 24.59 |
| D80948 | 1738 | EST | #N/A | #N/A | 70.05 | 77.71 | 32.11 | 41.25 | 43.53 | 17.46 |
| D81048 | 1739 | EST | #N/A | #N/A | 150.18 | 149.32 | 51.77 | 86.08 | 85.08 | 39.11 |
| F04320 | 1786 | replication factor C (activator 1) 4 (37kD) | 6.29 | 0.00042 | 156.76 | 122.53 | 109.02 | 14.92 | 17.26 | 9.79 |
| H14617 | 1884 | EST | #N/A | #N/A | 143.86 | 147.93 | 66.03 | 133.9 | 150.35 | 53.38 |
| H26763 | 1907 | EST | 3.67 | 0.00327 | 408.05 | 321.65 | 219.8 | 409.85 | 391.85 | 155.84 |
| H68794 | 1984 | EST | 7.5 | 0.02674 | 215.75 | 176.78 | 110.42 | 65.56 | 54 | 51.09 |
| H78211 | 2001 | EST | #N/A | #N/A | 285.43 | 307.06 | 261.02 | −115.95 | −129.18 | 70.22 |
| H95566 | 2050 | EST | #N/A | #N/A | 136.58 | 143.31 | 26.27 | 74.11 | 89.04 | 126.61 |
| H99870 | 2082 | EST | 6.48 | 0.00358 | 92.81 | 94.93 | 33.98 | 53.96 | 61.17 | 29.86 |
| N62487 | 2590 | EST | 3.38 | 0.03125 | 56.6 | 52.26 | 33.75 | 13.89 | 16.02 | 8.53 |
| N67815 | 2626 | EST | 3.84 | 0.00439 | 351.55 | 356.17 | 99.35 | 104.07 | 151.77 | 86.01 |
| N69084 | 2642 | EST | 3.11 | 0.0094 | 233.32 | 208.16 | 169.31 | 72.13 | 67.7 | 49.99 |
| N73278 | 2671 | tumor protein D52-like 2 | #N/A | #N/A | 77.72 | 71.59 | 49.4 | 25.36 | 19.22 | 26.85 |
| R06251 | 2763 | carbohydrate (keratan sulfate Gal-6) sulfotransferase 1 | 4.88 | 0.03097 | 466.88 | 341.39 | 380.43 | 74.25 | 66.72 | 64.11 |
| R15740 | 2790 | EST | 3.36 | 0.00268 | 117.43 | 100.03 | 64.73 | 31.77 | 21.3 | 33.53 |
| R24507 | 2801 | EST | #N/A | #N/A | 31.61 | 16.41 | 30.69 | 3 | 3.45 | 5.62 |
| R27296 | 2806 | EST | 3.41 | 0.00309 | 77.08 | 67.51 | 39.42 | 8.27 | 11.07 | 7.26 |
| R30931 | 2809 | EST | #N/A | #N/A | 54.19 | 57.09 | 29.34 | 17.58 | 13.67 | 14.21 |
| R45994 | 2866 | EST | 6.48 | 0.00358 | 730.52 | 598.82 | 420.14 | 145.88 | 160.69 | 163.03 |
| R70253 | 2944 | EST | 3.38 | 0.03125 | 99.7 | 88.01 | 87.93 | −9.59 | −0.47 | 30.83 |
| R72886 | 2955 | KIAA0422 protein | 5.5 | 0.00091 | 564.05 | 473.4 | 207.71 | 126.66 | 121.18 | 116.07 |
| R96924 | 3000 | EST | 7.04 | 0.00012 | 336.8 | 329 | 106.3 | 51.01 | 52.94 | 54.09 |
| T15852 | 3061 | EST | 5.21 | 0.00642 | 168.18 | 134.42 | 120.18 | −7.59 | 7.36 | 51.48 |
| T16983 | 3073 | cleavage and polyadenylation specific factor 4, 30kD subunit | 4.23 | 0.0106 | 262.26 | 268.2 | 155.86 | 65.64 | 45.67 | 74.28 |
| T33865 | 3109 | RNA (guanine-7-) methyltransferase | #N/A | #N/A | 29.73 | 32.86 | 22.11 | −0.26 | 2.33 | 8.15 |
| T66935 | 3178 | EST | 3.01 | 0.00123 | 181.34 | 189.67 | 61.49 | 66.8 | 52.94 | 42.32 |
| T95057 | 3258 | EST | 6.46 | 0.00613 | 229.11 | 188.71 | 174.46 | 7.13 | 15.37 | 37.2 |
| W45320 | 3520 | KRAB-associated protein 1 | 10.05 | 0.00002 | 365.22 | 345.46 | 124.13 | −2.52 | 25.03 | 112.32 |
| AF006041 | 1549 | death-associated protein 6 | #N/A | #N/A | 174.22 | 170.16 | 37.64 | 74.91 | 58.55 | 50.31 |
| D00596 | 1590 | thymidylate synthetase | 5.58 | 0.0098 | 200.17 | 128.11 | 170.5 | 20.16 | 20.43 | 12.43 |
| D38491 | 1653 | KIAA0117 protein | #N/A | #N/A | 47.67 | 52.03 | 21.01 | 20.77 | 20.88 | 17.43 |
| D63486 | 1712 | KIAA0152 gene product | 3.56 | 0.00063 | 277.42 | 248.24 | 99.25 | 84.6 | 95.61 | 45.48 |
| D84557 | 1749 | minichromosome maintenance deficient (mis5, S.pombe) 6 | 3.97 | 0.0017 | 184.48 | 132.11 | 125.74 | 37.22 | 43.12 | 28.15 |
| D86957 | 1754 | KIAA0202 protein | 3.08 | 0.02949 | 91.22 | 73.14 | 89.89 | 14.7 | 12.7 | 6.29 |

TABLE 8A-continued

Genes and ESTs expressed only in HCC2 vs Normal2

| Fragment Name | SEQ ID: | Known Gene Name | fold change in hcc set 2 | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| D86972 | 1755 | KIAA0218 gene product | #N/A | #N/A | 68.56 | 66.54 | 32.32 | 34.58 | 32.05 | 21.82 |
| D90097 | 1768 | amylase, alpha 2B; pancreatic | #N/A | #N/A | 41.19 | 37.49 | 21.85 | 6.55 | 11.44 | 15.06 |
| L29218 | 2190 | CDC-like kinase 2 | 3.82 | 0.00035 | 155.42 | 142.58 | 76.28 | 35.11 | 41.27 | 26.41 |
| L38696 | 2208 | RNA-binding protein (autoantigenic) | #N/A | #N/A | 127.32 | 114.91 | 62.34 | 60.18 | 58.55 | 24.77 |
| M11749 | 2240 | Thy-1 cell surface antigen | #N/A | #N/A | 83.1 | 65.86 | 64.52 | 26.05 | 28.95 | 20.56 |
| M25753 | 2308 | cyclin B1 | #N/A | #N/A | 44.14 | 30.96 | 40.36 | -0.8 | 3.03 | 15.35 |
| M32334 | 2333 | intercellular adhesion molecule 2 | #N/A | #N/A | 95.04 | 92.33 | 67.51 | 42.19 | 41.31 | 27.33 |
| M55210 | 2353 | laminin, gamma 1 (formerly LAMB2) | 3.47 | 0.02551 | 137.63 | 115.85 | 102.71 | 27.07 | 29.17 | 12.36 |
| M61916 | 2372 | laminin, beta 1 | 3.18 | 0.01171 | 75.1 | 67.4 | 61.41 | 7.19 | 7.98 | 8.99 |
| M86752 | 2411 | stress-induced-phosphoprotein 1 (Hsp70/Hsp90-organizing protein) | 5.15 | 0.02881 | 216.51 | 248.21 | 192.98 | 8.67 | 20.63 | 39.03 |
| M87339 | 2414 | replication factor C (activator 1) 4 (37kD) | 4.59 | 0.00116 | 110.39 | 82.61 | 79.29 | 4.26 | 9.92 | 16.79 |
| M94250 | 2425 | midkine (neurite growth-promoting factor 2) | 9.86 | 0.02104 | 690.32 | 193.74 | 1414.43 | -155.4 | -175.43 | 101.89 |
| S72904 | 3030 | cytosolic ovarian carcinoma antigen 1 | #N/A | #N/A | 29.33 | 29.21 | 18.34 | 11.53 | 12.85 | 7.55 |
| S78187 | 3035 | cell division cycle 25B | 4.83 | 0.0047 | 143.52 | 115.3 | 109.13 | 3.36 | -1.2 | 26.9 |
| S78569 | 3036 | laminin, alpha 4 | #N/A | #N/A | 25.79 | 26.91 | 21.66 | 6.3 | 7.6 | 9.38 |
| U38847 | 3356 | TAR (HIV) RNA-binding protein 1 | #N/A | #N/A | 83.43 | 70.23 | 66.3 | 15.7 | 17.43 | 10.2 |
| U51477 | 3383 | diacylglycerol kinase, zeta (104kD) | #N/A | #N/A | 73.85 | 61.64 | 31.81 | 36.35 | 36.29 | 23.02 |
| U59321 | 3397 | DEAD/H (Asp-Glu-Ala-Asp/His) box polypeptide 17 (72kD) | 3.12 | 0.02469 | 84.5 | 98.2 | 70.13 | 3.1 | -1.83 | 19.73 |
| U66661 | 3405 | gamma-aminobutyric acid (GABA) A receptor, epsilon | 3.55 | 0.0045 | 97.79 | 83.66 | 61.79 | 16.58 | 14.81 | 11.96 |
| U93237 | 3461 | multiple endocrine neoplasia I | #N/A | #N/A | 84.78 | 93.3 | 24.25 | 45.63 | 45.39 | 17.66 |
| X92106 | 3819 | bleomycin hydrolase | #N/A | #N/A | 56.15 | 48.48 | 36.93 | 4.73 | 3.77 | 11.78 |
| X92762 | 3825 | tafazzin (cardiomyopathy, dilated 3A (X-linked); endocardial fibroelastosis 2; Barth syndrome) | #N/A | #N/A | 82.96 | 83.94 | 15.05 | 23.4 | 33.5 | 24.15 |
| Y09216 | 3853 | dual-specificity tyrosine-(Y)-phosphorylation regulated kinase 2 | #N/A | #N/A | 47.87 | 47.61 | 18.08 | 18.99 | 22.48 | 13.31 |
| M69013 | 2390 | guanine nucleotide binding protein (G protein), alpha 11 (Gq class) | #N/A | #N/A | 86.89 | 70.61 | 47.65 | 38.18 | 47.33 | 23.06 |
| AD000092 | 1542 | RAD23 (S.cerevisiae) homolog A | #N/A | #N/A | 97.12 | 98.23 | 25.66 | 37.18 | 32.35 | 28.04 |
| X04654 | 3678 | small nuclear ribonucleoprotein 70kD polypeptide (RNP antigen) | #N/A | #N/A | 122.45 | 134.9 | 49.51 | 42.22 | 41.24 | 17.18 |
| M31211 | 2326 | myosin, light polypeptide 1, alkali; skeletal, fast | #N/A | #N/A | 60.22 | 49.75 | 54.83 | -2.19 | -4.38 | 11.56 |
| U50648 | 3378 | protein kinase, interferon-inducible double stranded RNA dependent | #N/A | #N/A | 214.34 | 192.86 | 122.38 | 105.38 | 92.58 | 43.12 |
| M74715 | 2394 | iduronidase, alpha-L- | #N/A | #N/A | 122.69 | 121.95 | 72.58 | 41.88 | 24.48 | 43.99 |
| U41767 | 3359 | a disintegrin and metalloproteinase domain 15 (metargidin) | #N/A | #N/A | 196.76 | 147.11 | 113.93 | 83.03 | 66.93 | 68.33 |
| M12125 | 2241 | tropomyosin 2 (beta) | 7.13 | 0.0004 | 174.25 | 183.97 | 95.24 | 13.01 | 16.33 | 11.64 |
| U20499 | 3320 | sulfotransferase family 1A, phenol-preferring, member 3 | #N/A | #N/A | 141.35 | 126.33 | 135.57 | 48.34 | 54.37 | 24.69 |

TABLE 8B

Genes and ESTs expressed only in Normal2 vs HCC2

| Fragment Name | SEQ ID: | Known Gene Name | hcc fold change | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| H66367 | 1977 | EST | 3.84 | 0.00133 | 37.14 | 35.15 | 26.61 | 155.38 | 149.31 | 70.77 |
| H72650 | 1994 | EST | #N/A | #N/A | 78.97 | 93.74 | 40.9 | 122 | 125 | 42.24 |
| M30185 | 2321 | cholesteryl ester transfer protein, plasma | 3.82 | 0.00131 | −15.66 | −12.63 | 23.86 | 93.07 | 86.04 | 61.35 |
| N99542 | 2746 | orosomucoid 1 | 3.53 | 0.00607 | 61.09 | 67.97 | 39.3 | 226.06 | 187.68 | 146.11 |
| T68083 | 3184 | short-chain dehydrogenase/reductase 1 | #N/A | #N/A | 96.34 | 59.71 | 104.53 | 263.22 | 280.22 | 136.48 |
| Z48475 | 3940 | glucokinase (hexokinase 4) regulatory protein | 4.6 | 0.01693 | 65.99 | 51.37 | 146.72 | 305.23 | 239.52 | 155.98 |
| AA046747 | 114 | EST | 4.77 | 0.00023 | −0.57 | 3.68 | 23.81 | 113.78 | 88.54 | 66.41 |
| AA253410 | 564 | EST | #N/A | #N/A | 3.66 | 1.48 | 10.67 | 49.37 | 26.82 | 45.2 |
| AA281796 | 650 | mannose-P-dolichol utilization defect 1 | #N/A | #N/A | 95.74 | 105.86 | 45.46 | 170.88 | 165.02 | 41.87 |
| AA287566 | 690 | KIAA0187 gene product | 6.99 | 0.00023 | 18.67 | 14.05 | 35.71 | 246.24 | 201.66 | 228.64 |
| AA404248 | 847 | EST | #N/A | #N/A | 24.05 | 30.59 | 15.83 | 40.92 | 35.06 | 17.49 |
| AA448002 | 1113 | putative type II membrane protein | 14.14 | 0 | 39.9 | 38.99 | 13.33 | 594.13 | 528.63 | 282.58 |
| AA487576 | 1357 | EST | #N/A | #N/A | 11.67 | 2.42 | 27.75 | 26.05 | 25.27 | 11.13 |
| AA621235 | 1517 | EST | #N/A | #N/A | 65.79 | 68.63 | 35.33 | 114.75 | 113.36 | 65.35 |
| F09979 | 1809 | EST | #N/A | #N/A | 61.21 | 6.31 | 128.69 | 226.47 | 116.41 | 288.21 |
| H57056 | 1953 | EST | #N/A | #N/A | −1.79 | −7.37 | 11.38 | 35.07 | 38.32 | 17.88 |
| H58673 | 1959 | EST | 15.49 | 0.00002 | 34.96 | 26.37 | 38.53 | 652.47 | 677.55 | 376.36 |
| H59136 | 1962 | EST | 6.63 | 0.00033 | 33.12 | 21.17 | 42.92 | 250.23 | 229.94 | 129.12 |
| H87765 | 2017 | KIAA0626 gene product | 3.94 | 0.00123 | 10.11 | 10.07 | 4.23 | 94.26 | 93.78 | 60.64 |
| N22404 | 2449 | EST | 3.44 | 0.02267 | 56.69 | 35.82 | 73.26 | 193.63 | 130.09 | 162.83 |
| N34919 | 2498 | EST | #N/A | #N/A | 19.32 | 19.72 | 14.37 | 52.96 | 44.23 | 24.23 |
| N54604 | 2569 | EST | #N/A | #N/A | 45.27 | 14.34 | 81.45 | 133.06 | 119.1 | 109.95 |
| N65959 | 2611 | EST | 3.38 | 0.00785 | 37.8 | 28.94 | 31.45 | 142.87 | 149.26 | 79.26 |
| N74624 | 2687 | collectin sub-family member 10 (C-type lectin) | #N/A | #N/A | 39.43 | 35.17 | 24.21 | 71.81 | 62.09 | 43.57 |
| R09053 | 2782 | EST | 3.45 | 0.03074 | 64.12 | 36.33 | 102.03 | 186.87 | 204.61 | 113.19 |
| R73816 | 2960 | EST | 7.05 | 0.01287 | 35.12 | 13.76 | 100.6 | 462.31 | 374.67 | 450.91 |
| T58756 | 3155 | EST | 16.61 | 0 | −1.02 | 1.06 | 24.36 | 390.04 | 386.76 | 164.41 |
| W48860 | 3534 | EST | #N/A | #N/A | 37.25 | 31.7 | 27.5 | 52.69 | 41.31 | 21.1 |
| W90018 | 3639 | EST | #N/A | #N/A | 21.51 | 1.31 | 56.9 | 59.32 | 53.19 | 41.68 |
| AA010205 | 23 | potassium voltage-gated channel, shaker-related subfamily, beta member 1, | 5.71 | 0.00014 | 26.95 | 20.06 | 32.19 | 187.55 | 154.99 | 92.13 |
| AA013095 | 33 | macrophage receptor with collagenous structure | #N/A | #N/A | 5.12 | 7.9 | 12.98 | 18.56 | 15.83 | 8.24 |
| AA074885 | 161 | EST | 10.88 | 0.00087 | 35.67 | 58.01 | 44.34 | 652.03 | 761.74 | 300.57 |
| AA09225 | 206 | EST | 6.59 | 0.00064 | 10.9 | 9.75 | 15.11 | 212.68 | 163.45 | 194.31 |
| AA282541 | 661 | CD5 antigen-like (scavenger receptor cysteine rich family) | #N/A | #N/A | 17.21 | 11.75 | 13.38 | 31.31 | 29.9 | 13.53 |
| R99591 | 3015 | EST | 7.41 | 0.00043 | 124.14 | 139.76 | 50.35 | 1035.39 | 904.92 | 691.83 |
| T68711 | 3187 | X-prolyl aminopeptidase (aminopeptidase P) | 35.98 | 0.0003 | 29.03 | −33.95 | 176.15 | 1388.67 | 1074.67 | 890.91 |

TABLE 8B-continued

Genes and ESTs expressed only in Normal2 vs HCC2

| Fragment Name | SEQ ID: | Known Gene Name | hcc fold change | p value | hcc sample set 2: Mean | hcc sample set 2: Median | hcc sample set 2: Std Dev | normal set 2: Mean | normal set 2: Median | normal set 2: Std Dev |
|---|---|---|---|---|---|---|---|---|---|---|
| W78093 | 3598 | 2, membrane-bound | #N/A | #N/A | 408.58 | 397.88 | 102.27 | 518.77 | 518.8 | 211.32 |
| W85890 | 3620 | EST | #N/A | #N/A | 60.91 | 60.47 | 23.73 | 70.98 | 66.52 | 24.66 |
| AA285053 | 681 | EST | 5 | 0.00718 | 36.49 | 20.15 | 49.24 | 238.16 | 242.27 | 169.12 |
| AA460661 | 1229 | EST | 5.46 | 0.00151 | 20.05 | 8.57 | 39.04 | 184.62 | 198.21 | 108.17 |
| F10380 | 1816 | butyrobetaine (gamma), 2-oxoglutarate dioxygenase (gamma-butyrobetaine hydroxylase) | #N/A | #N/A | 43.64 | 47.09 | 18.15 | 106.49 | 93.71 | 83.35 |
| N67105 | 2623 | EST | 4.69 | 0.00194 | 12.46 | 10.45 | 12.64 | 143.36 | 102.9 | 121.4 |
| N69114 | 2643 | nuclear receptor subfamily 1, group I, member 3 | #N/A | #N/A | 12.69 | 5.95 | 15.01 | 72.29 | 73.28 | 57.34 |
| M63967 | 2378 | aldehyde dehydrogenase 5 | 3.88 | 0.00274 | 40.43 | 30.04 | 29.05 | 164.38 | 178.74 | 87.39 |
| X54380 | 3727 | pregnancy-zone protein | 7.71 | 0.00069 | 15.11 | 8.07 | 27.07 | 274.41 | 255.4 | 203.47 |
| Z49269 | 3942 | small inducible cytokine subfamily A (Cys-Cys), member 14 | 7.24 | 0.01047 | 138.63 | 66.95 | 201.93 | 526.13 | 532.29 | 166.67 |
| M10943 | 2234 | metallothionein 1F (functional) | 6.23 | 0.00007 | 35.67 | 28.76 | 22.4 | 217.65 | 186.71 | 86.73 |

TABLE 9A

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA009913 | 21 | diptheria toxin resistance protein required for diphthamide biosynthesis (Saccharomyces)-like 2 | #N/A | #N/A | 69.53 | 81.03 | 27.69 | 16.81 | 18.22 | 13.51 |
| AA127712 | 255 | EST | 6.59 | 0.03706 | 332.45 | 208.85 | 296.68 | −29.54 | −28.71 | 104.37 |
| AA253330 | 562 | adaptor-related protein complex 1, gamma 1 subunit | 3.87 | 0.00708 | 219.95 | 186.12 | 141.92 | 47.32 | 51.59 | 30.28 |
| AA291456 | 700 | EST | 3.96 | 0.03633 | 1808.4 | 1273.75 | 1481.84 | 671.21 | 509.58 | 629.13 |
| AA295819 | 722 | EST | 8 | 0.01793 | 230.14 | 251.43 | 146.89 | −14.93 | −20.8 | 19.72 |
| AA372630 | 769 | differentially expressed in hematopoietic lineages | 25.49 | 0.01743 | 2094.32 | 436.62 | 3873.61 | 6.67 | 4.87 | 7.16 |
| AA384184 | 774 | DKFZP586B0519 protein | 3.38 | 0.01209 | 476.17 | 411.64 | 148.86 | 181.02 | 188.54 | 135.4 |
| AA427468 | 973 | claudin 4 | 84.43 | 0 | 5646.4 | 5344.98 | 1581.19 | 72.58 | 64.85 | 87.74 |
| AA454908 | 1171 | KIAA0144 gene product | 9.3 | 0.00539 | 320.03 | 253.32 | 238.5 | −33.7 | −46.73 | 73.56 |
| AB002304 | 1534 | KIAA0306 protein | #N/A | #N/A | 584.5 | 621.94 | 136.64 | 313.99 | 298.88 | 88.6 |
| AB002349 | 1537 | KIAA0351 gene product | #N/A | #N/A | 65.63 | 52.11 | 32.26 | 49.37 | 46.52 | 37.93 |
| AF003521 | 1545 | jagged 2 | 11.26 | 0.00008 | 426 | 330.95 | 309.91 | 15.48 | −3.6 | 91.81 |
| C00808 | 1553 | EST | #N/A | #N/A | 122.57 | 118.32 | 53.36 | 91.65 | 87.87 | 32.51 |
| C14228 | 1567 | EST | #N/A | #N/A | 39.93 | 33.15 | 13.59 | −0.51 | 2.85 | 8.61 |
| D83783 | 1748 | trinucleotide repeat containing 11 (THR-associated protein, 230 kDa subunit) | 6.55 | 0.00176 | 236.64 | 156.39 | 216.64 | 23.23 | 19.65 | 27.84 |
| D88154 | 1766 | villin-like | 4.18 | 0.00051 | 117.8 | 129.16 | 47.7 | 23.85 | 18.99 | 17.79 |
| H43286 | 1929 | gamma-aminobutyric acid (GABA) B receptor, 1 | 5.02 | 0.01972 | 377.04 | 222.91 | 315.96 | 57.02 | 63.58 | 24.25 |
| H53657 | 1945 | adenylate cyclase 3 | 3.98 | 0.0045 | 140.07 | 111.99 | 74.77 | 31.33 | 31.74 | 15.29 |
| L08044 | 2149 | trefoil factor 3 (intestinal) | 21.42 | 0.01674 | 2956.22 | 1618.2 | 3127.19 | 107.82 | 58.55 | 184.16 |
| M94891 | 2428 | pregnancy specific beta-1-glycoprotein 4, pregnancy specific beta-1-glycoprotein 7 | #N/A | #N/A | 221.09 | 197.74 | 80.32 | 178.23 | 166.98 | 61.33 |
| R56678 | 2907 | EST | 3.81 | 0.02242 | 98.37 | 78.38 | 75.74 | 2.67 | 5 | 5.82 |
| R69700 | 2942 | EST | 6.71 | 0.0021 | 387.34 | 393.81 | 94.86 | 79.33 | 57.85 | 129.97 |
| R76363 | 2961 | EST | #N/A | #N/A | 47.81 | 38.04 | 24.76 | 12.67 | 16.94 | 13.17 |
| U75968 | 3422 | DEAD/H (Asp-Glu-Ala-Asp/His) box polypeptide 11 (S.cerevisiae CHL1-like helicase) | #N/A | #N/A | 195.48 | 155.37 | 89.8 | 115.5 | 102.24 | 77.72 |
| W95348 | 3660 | HSPC113 protein | 10.89 | 0.01065 | 555.52 | 492.63 | 563.86 | 26.59 | 29.36 | 21.03 |
| AA007160 | 16 | EST | 6 | 0.01035 | 171.32 | 175.07 | 138.03 | 9.1 | 8.6 | 12.54 |
| AA024482 | 45 | DKFZP434G032 protein | #N/A | #N/A | 207.37 | 118.58 | 230.63 | −1.3 | −3.13 | 13.6 |
| AA040465 | 95 | EST | 3.25 | 0.00146 | 161.91 | 125.35 | 72.19 | 47.15 | 45.53 | 5.48 |
| AA053660 | 128 | EST | 15.98 | 0.00003 | 1573.49 | 1340 | 820.5 | 95.24 | 79.97 | 42.99 |
| AA100719 | 212 | carcinoembryonic antigen-related cell adhesion molecule 6 (non-specific cross reacting antigen) | 50.88 | 0.00081 | 1405.2 | 1264.79 | 1137.97 | −17.03 | −22.23 | 16.43 |
| AA115979 | 232 | mitotic spindle coiled-coil related protein | #N/A | #N/A | 74.58 | 89.38 | 66.52 | 22.91 | 13.67 | 29.42 |
| AA134968 | 289 | EST | 12.11 | 0.00079 | 322.34 | 208.47 | 256.66 | 10.04 | 7.96 | 15.53 |
| AA179787 | 380 | polyglutamine binding protein 1 | 6.44 | 0.00206 | 191.33 | 171.71 | 138.9 | −11.56 | −12.46 | 42.46 |
| AA227926 | 460 | EST | 6.81 | 0.01701 | 228.91 | 120.1 | 243.92 | 16.24 | 14.21 | 6.86 |
| AA235707 | 500 | EST | 9.17 | 0.00005 | 189.42 | 161.88 | 57.05 | −18.19 | −19.06 | 14.8 |
| AA236533 | 514 | ecotropic viral integration site 1 | 4.01 | 0.02882 | 106.15 | 76.05 | 78.18 | −16.45 | −14.04 | 8.52 |
| AA243173 | 526 | EST | 8.75 | 0.00003 | 384.86 | 482.53 | 162.08 | 41.66 | 40.74 | 27.31 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA262943 | 611 | EST | 13.42 | 0.00234 | 430.7 | 207.29 | 511.01 | -1.08 | -6.93 | 19.06 |
| AA281214 | 643 | neuroblastoma-amplified protein | #N/A | #N/A | 130.98 | 133.63 | 68.42 | 69.89 | 53.91 | 39.31 |
| AA282505 | 659 | EST | #N/A | #N/A | 461.54 | 478.83 | 622.39 | -41.45 | -17 | 98.17 |
| AA292931 | 715 | EST | 3.97 | 0.00067 | 230.65 | 260.43 | 79.42 | 57.32 | 61.89 | 18.62 |
| AA372018 | 768 | EST | 14.3 | 0.00178 | 363.44 | 220.03 | 261.04 | -2.44 | -3.09 | 8.36 |
| AA394121 | 778 | laminin receptor 1 (67kD, ribosomal protein SA) | 23.78 | 0.00099 | 788.51 | 677.33 | 612.74 | 0.21 | -8.38 | 31.59 |
| AA399226 | 803 | tight junction protein 3 (zona occludens 3) | 3.59 | 0.02002 | 89.54 | 78.97 | 63.98 | -5.01 | -6.48 | 11.33 |
| AA401965 | 833 | tumor suppressor deleted in oral cancer-related 1 | #N/A | #N/A | 384.12 | 271.95 | 444.06 | 120.58 | 93.29 | 109.41 |
| AA404597 | 854 | EST | #N/A | #N/A | 624.37 | 495.56 | 274.8 | 379.26 | 336.33 | 167.43 |
| AA410469 | 883 | EST | 6.3 | 0.00103 | 337.03 | 250.11 | 264.1 | 50.51 | 42.79 | 60.18 |
| AA419217 | 923 | DKFZP586E1422 protein | 6.77 | 0.00045 | 276.53 | 215.37 | 172.25 | 36.93 | 36.7 | 21.88 |
| AA424881 | 949 | EST | 6.3 | 0.00556 | 158.13 | 155.45 | 82.63 | -16.85 | -22.15 | 20.49 |
| AA425852 | 958 | EST | 4.8 | 0.03874 | 149.8 | 125.7 | 128.03 | 7.02 | 5.22 | 4.75 |
| AA430674 | 1018 | EST | 15.11 | 0.00293 | 454.82 | 306.15 | 378.36 | -71.57 | -82.03 | 59.56 |
| AA442763 | 1072 | cyclin B2 | 5.09 | 0.02168 | 136.16 | 109.91 | 91.52 | -14.64 | -15.1 | 13.08 |
| AA443941 | 1085 | tumor suppressing subtransferable candidate 1 | 3.57 | 0.01685 | 137.02 | 138.22 | 83.35 | 31.09 | 34.9 | 16.61 |
| AA449456 | 1126 | EST | 6.29 | 0.00087 | 847.4 | 775.81 | 377.99 | 160.93 | 178.76 | 112.71 |
| AA451877 | 1138 | EST | 8.63 | 0.00489 | 239.55 | 157.3 | 244.02 | -27.28 | -27.59 | 18.28 |
| AA454597 | 1166 | EST | 3.63 | 0.0067 | 268.15 | 274.94 | 167.72 | 66.6 | 57.29 | 23.41 |
| AA457235 | 1200 | EST | #N/A | #N/A | 481.26 | 138.32 | 573.73 | 11.06 | 17.32 | 15.26 |
| AA460666 | 1231 | EST | #N/A | #N/A | 56.19 | 58.13 | 26.29 | -24.55 | -17.23 | 20.98 |
| AA463861 | 1251 | EST | 24.79 | 0.00096 | 672.22 | 311.71 | 641.54 | -22.02 | -20.04 | 16.5 |
| AA464962 | 1264 | EST | #N/A | #N/A | 61.02 | 56.4 | 30.98 | 20.99 | 14.37 | 19.64 |
| AA465342 | 1271 | EST | #N/A | #N/A | 113.36 | 100.15 | 87.62 | 30.07 | 33.06 | 23.97 |
| AA465660 | 1273 | LIM domain binding 1 | #N/A | #N/A | 171.26 | 118.15 | 103.39 | 124.59 | 105.93 | 56.71 |
| AA476749 | 1286 | tumor necrosis factor receptor superfamily, member 12 (translocating chain-association membrane protein) | #N/A | #N/A | 53.23 | 44.04 | 18.16 | 25.5 | 29.62 | 11.96 |
| AA477561 | 1292 | EST | #N/A | #N/A | 160.87 | 104.95 | 133.7 | 63.83 | 76.56 | 37.87 |
| AA482546 | 1336 | KIAA0124 protein | 4.41 | 0.00604 | 181.72 | 113.91 | 140.73 | 38.26 | 30.26 | 32.72 |
| AA609795 | 1492 | EST | #N/A | #N/A | 74.38 | 34 | 77.76 | -41.44 | -45.5 | 28.82 |
| AA621277 | 1520 | EST | 3.81 | 0.00194 | 81.18 | 74.81 | 30.84 | -0.15 | 1.98 | 12.84 |
| F09788 | 1808 | procollagen-proline, 2-oxoglutarate 4-dioxygenase (proline 4-hydroxylase), alpha polypeptide II | 4.14 | 0.00003 | 104.92 | 112.31 | 27.67 | 19.92 | 20.29 | 13.83 |
| H09281 | 1863 | EST | 6 | 0.00966 | 147.11 | 187.25 | 71.67 | -2.97 | -0.54 | 11.7 |
| H59617 | 1964 | EST | 3.3 | 0.04588 | 116.07 | 71.39 | 101 | 19.24 | 21.65 | 16.88 |
| H98657 | 2068 | KIAA0124 protein | #N/A | #N/A | 179.15 | 192.17 | 32.25 | 111.2 | 84.74 | 128.92 |
| N22015 | 2447 | EST | 46.61 | 0.00025 | 1225.51 | 887.65 | 1106.3 | -5.3 | -6.84 | 18.82 |
| N35376 | 2500 | EST | #N/A | #N/A | 39.01 | 35.99 | 19.81 | 28.53 | 29.44 | 8.2 |
| N63165 | 2597 | EST | #N/A | #N/A | 68.04 | 62.1 | 44.7 | 30.07 | 26.23 | 13.84 |
| N64616 | 2610 | EST | 3.11 | 0.0074 | 68.89 | 75.8 | 32.12 | -0.83 | 9.77 | 28.69 |
| N66951 | 2620 | EST | 5.54 | 0.02442 | 451.16 | 432.45 | 381.81 | 59.83 | 75.27 | 32.75 |
| N72116 | 2667 | solute carrier family 11 (proton-coupled divalent metal ion transporters), member 2 | 9.01 | 0.00051 | 338.43 | 314.06 | 196.66 | 32.57 | 29.68 | 20.1 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| N92659 | 2720 | EST | #N/A | #N/A | 31.19 | 37.23 | 14.14 | 5.91 | 4.05 | 5.63 |
| R06866 | 2773 | EST | 5.18 | 0.00187 | 148.48 | 114.86 | 102.01 | 18.26 | 15.16 | 17.11 |
| R26744 | 2803 | midline 1 (Opitz/BBB syndrome) | 4.32 | 0.00532 | 112.54 | 90 | 76.53 | -0.2 | -3.06 | 24.42 |
| R36109 | 2822 | EST | #N/A | #N/A | 47.54 | 48.43 | 19.9 | 25.67 | 20.25 | 34.73 |
| R38511 | 2831 | protein similar to E.coli yhdg and R. capsulatus nifR3 | 5.19 | 0.00015 | 131.5 | 147.54 | 44.02 | 21.3 | 23.75 | 9.22 |
| R39191 | 2833 | KIAA1020 protein | 4.69 | 0.00456 | 130.93 | 145.31 | 62.13 | 17.46 | 18.33 | 16.04 |
| R40057 | 2838 | prominin (mouse)-like 1 | #N/A | #N/A | 47.6 | 46.28 | 36.57 | 0.83 | -0.8 | 7.91 |
| R44817 | 2859 | EST | #N/A | #N/A | 600.1 | 550.42 | 309.14 | 255.91 | 249.29 | 69.09 |
| R49047 | 2877 | Fc fragment of IgG, low affinity IIIa, receptor for (CD16) | #N/A | #N/A | 44.49 | 36.71 | 14.37 | 15.43 | 14.16 | 14.13 |
| R54935 | 2902 | ubiquitin specific protease 7 (herpes virus-associated) | #N/A | #N/A | 75.76 | 81.15 | 31.57 | 17.77 | 14 | 18.86 |
| R55470 | 2903 | EST | 3.59 | 0.00515 | 256.38 | 225.69 | 138.22 | 75.29 | 73.42 | 53.04 |
| R59093 | 2910 | EST | #N/A | #N/A | 57.79 | 33.48 | 73.58 | 12.26 | 10.21 | 7.73 |
| R63925 | 2928 | EST | #N/A | #N/A | 70.52 | 60.93 | 15.36 | 49.82 | 52.73 | 13.77 |
| R71395 | 2951 | EST | 10.42 | 0.00422 | 318.75 | 274.93 | 227.75 | 14.99 | 12.28 | 14.58 |
| R85266 | 2976 | EST | #N/A | #N/A | 53.4 | 54.53 | 25.44 | 48.68 | 39.83 | 33.9 |
| R91819 | 2983 | EST | 8.95 | 0.00009 | 263.33 | 219.91 | 135.67 | 11.34 | 9.35 | 36.49 |
| T03438 | 3042 | EST | 8.18 | 0.00032 | 300.09 | 229.6 | 218.02 | 31.03 | 28.88 | 15.86 |
| T03541 | 3044 | EST | #N/A | #N/A | 455.39 | 418.21 | 288.45 | 155.27 | 155.62 | 50.93 |
| T25744 | 3091 | EST | #N/A | #N/A | 79.78 | 68.72 | 52.01 | 15.56 | 12.65 | 13.18 |
| T53404 | 3142 | EST | 10.68 | 0.00582 | 654.13 | 475.25 | 687.49 | 48.3 | 0.6 | 93.06 |
| T91116 | 3251 | EST | 4.01 | 0.02721 | 133.54 | 61.72 | 126.12 | 16.62 | 11.42 | 13.64 |
| T96060 | 3262 | EST | #N/A | #N/A | 910.76 | 225.75 | 1282.67 | 67.92 | 70.44 | 91.72 |
| W02695 | 3466 | EST | #N/A | #N/A | 129.58 | 99.52 | 100.52 | 30.69 | 33.06 | 16.14 |
| W67251 | 3567 | EST | 6.13 | 0.01463 | 204.71 | 182.17 | 127.82 | 21.77 | 23.88 | 12.17 |
| W78057 | 3597 | EST | 9.06 | 0.0034 | 397.29 | 374.78 | 305.93 | 29.21 | 29.9 | 34.33 |
| W90146 | 3641 | EST | 6.23 | 0.01558 | 170.66 | 147.78 | 126.32 | 9.93 | 8.63 | 6.49 |
| W92449 | 3649 | EST | 31.67 | 0.00011 | 715.17 | 491.5 | 459.71 | -40.13 | -40.74 | 17.76 |
| Z39191 | 3898 | EST | 8.84 | 0.00011 | 442.36 | 371.88 | 228.18 | 46.98 | 49.3 | 33.31 |
| Z39569 | 3906 | EST | #N/A | #N/A | 166.55 | 125.78 | 217.77 | -9.57 | -12.15 | 17.32 |
| Z41415 | 3930 | EST | #N/A | #N/A | 199.73 | 88.96 | 271.2 | 10.38 | 6.64 | 11.47 |
| AA026030 | 53 | EST | 11.01 | 0.01649 | 566.65 | 284.32 | 828.01 | 3.02 | 4.66 | 40.87 |
| AA026270 | 56 | tyrosyl-tRNA synthetase | #N/A | #N/A | 201.1 | 224.51 | 50.82 | 76.85 | 76.68 | 45.22 |
| AA043944 | 100 | EST | #N/A | #N/A | 52.9 | 29.13 | 46.43 | 3.69 | 3.15 | 7.26 |
| AA053102 | 125 | cadherin 17, LI cadherin (liver-intestine) | 26.63 | 0.01745 | 1053.43 | 972.71 | 785.51 | 4.92 | 4.94 | 9.04 |
| AA053248 | 126 | EST | 7.01 | 0.00003 | 2234.44 | 1595.15 | 1053.3 | 341.06 | 304.8 | 189.89 |
| AA055896 | 135 | collagen, type V, alpha 1 | 18.16 | 0.00146 | 540.67 | 538.43 | 382 | -3.14 | -5.8 | 33.88 |
| AA084343 | 178 | EST | #N/A | #N/A | 133.86 | 126.19 | 19.99 | 84.58 | 76.82 | 41.45 |
| AA112979 | 225 | vaccinia related kinase 1 | #N/A | #N/A | 25.08 | 24.98 | 13.02 | 8.54 | 8.02 | 2.59 |
| AA126041 | 244 | EST | #N/A | #N/A | 42.91 | 33.83 | 16.2 | 26.42 | 28.92 | 9.81 |
| AA128553 | 260 | amyloid beta (A4) precursor protein (protease nexin-II, Alzheimer disease) | #N/A | #N/A | 87.35 | 102.82 | 24.17 | 114.91 | 108.16 | 30.28 |
| AA150053 | 327 | EST | 3.71 | 0.00102 | 309.61 | 304.16 | 82.48 | 101.87 | 88.37 | 73.73 |
| AA151428 | 335 | matrix metalloproteinase 23B | 7.15 | 0.00056 | 174.77 | 131.66 | 104.51 | 3.23 | 10.67 | 24.39 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA156243 | 340 | serine protease, umbilical endothelium | 41.44 | 0.00139 | 1255.4 | 547.15 | 1189.26 | 9.32 | 11.44 | 9.39 |
| AA159525 | 354 | EST | 49.39 | 0.00062 | 1309.05 | 1107.08 | 965.67 | -32.72 | -28.32 | 20.11 |
| AA161043 | 356 | tetraspan 1 | 18.8 | 0.00015 | 1477.19 | 932.02 | 1467.59 | 70.82 | 58.62 | 42.88 |
| AA171760 | 367 | EST | 17.86 | 0 | 645.43 | 578.38 | 312.37 | 28.03 | 16.24 | 57.21 |
| AA179845 | 381 | EST | 5.77 | 0.01414 | 280.06 | 335.41 | 172.62 | 37.43 | 37.69 | 14.87 |
| AA181600 | 384 | EST | 5.38 | 0.03316 | 166.88 | 94.16 | 153.49 | -40.51 | -47.81 | 24.34 |
| AA196790 | 421 | EST | 7.64 | 0.00287 | 239.45 | 275.18 | 142.37 | 22.91 | 26.8 | 10.54 |
| AA211483 | 435 | EST | 44.07 | 0.00175 | 1300.23 | 1303.61 | 1051.58 | -29.25 | -34.99 | 17.49 |
| AA232508 | 464 | EST | #N/A | #N/A | 464 | 533.98 | 266.87 | 170.48 | 156.89 | 104.75 |
| AA233290 | 469 | general transcription factor IIIC, polypeptide I (alpha subunit, 220kD) | 23.72 | 0.00018 | 607.06 | 420.34 | 366.53 | -3.47 | 1.73 | 30.91 |
| AA234096 | 479 | EST | #N/A | #N/A | 56.54 | 43.91 | 22.15 | 28.32 | 31.59 | 25.36 |
| AA234346 | 480 | EST | #N/A | #N/A | 36.98 | 39.47 | 12.81 | 6.21 | 6.79 | 19.99 |
| AA234362 | 481 | EST | 3.89 | 0.03524 | 116.26 | 75.37 | 105.77 | -1.86 | -4.2 | 16.67 |
| AA234365 | 482 | survival of motor neuron protein interacting protein 1 | #N/A | #N/A | 56.37 | 42.6 | 34.73 | 12.96 | 16.93 | 12.99 |
| AA234706 | 488 | EST | #N/A | #N/A | 68.33 | 53.21 | 21.55 | 49.66 | 39.76 | 42.06 |
| AA253473 | 567 | EST | 15.23 | 0.00171 | 375.2 | 435.68 | 216.18 | -4.38 | -3.19 | 12.35 |
| AA255566 | 570 | EST | #N/A | #N/A | 63.43 | 65.2 | 30.17 | 16.18 | 14.38 | 13.17 |
| AA256642 | 582 | EST | 11.17 | 0.00035 | 266.31 | 275.43 | 135.85 | 0.78 | -1.34 | 15.74 |
| AA292765 | 712 | EST | 7.14 | 0.02623 | 230.83 | 166.72 | 232.16 | 11.33 | 18.29 | 13.27 |
| AA331393 | 739 | ZW10 interactor | 16.73 | 0.00848 | 600.02 | 315.98 | 598.52 | 5.08 | 3.88 | 9.43 |
| AA349792 | 759 | mutY (E. coli) homolog | #N/A | #N/A | 525.17 | 553.97 | 245.2 | 221.5 | 212.24 | 98.86 |
| AA398908 | 801 | EST | 38.69 | 0.01089 | 1678.58 | 1796.68 | 1500.48 | -174.29 | -216.08 | 104.42 |
| AA405715 | 862 | hypothetical protein | 4.68 | 0.00898 | 152.23 | 138.92 | 96.78 | 24.47 | 27.3 | 11.75 |
| AA406542 | 878 | EST | 8.27 | 0.00724 | 230.18 | 170.94 | 206.8 | -1.99 | 1.49 | 12.75 |
| AA421562 | 934 | anterior gradient 2 (Xenopus laevis) homolog | 56.3 | 0.0041 | 2556.78 | 792 | 3323.39 | 14.22 | 15.72 | 6.54 |
| AA424487 | 945 | EST | 38.41 | 0.00002 | 2689.32 | 1863.02 | 1900.51 | 67.92 | 61.95 | 46.24 |
| AA425279 | 951 | quiescin Q6 | 6.15 | 0.00083 | 221.93 | 181.8 | 167.44 | 18.33 | 22.33 | 44.81 |
| AA425401 | 954 | serine/threonine kinase 24 (Ste20, yeast homolog) | 3.22 | 0.00625 | 246.6 | 166.4 | 175.99 | 76.4 | 78.33 | 43.72 |
| AA429009 | 994 | serine protease inhibitor, Kunitz type 1 | 30.04 | 0.00001 | 1010.32 | 1100.19 | 472.23 | -2.97 | -24.67 | 62.21 |
| AA436616 | 1056 | EST | 3.18 | 0.04402 | 79.96 | 91.35 | 62.83 | -0.73 | 3.24 | 15.36 |
| AA447687 | 1104 | EST | 11.42 | 0.00362 | 306.28 | 178.65 | 244.12 | -16.27 | -14.45 | 8.55 |
| AA447991 | 1112 | EST | 4.99 | 0.00173 | 279.79 | 234.63 | 161.24 | 64.49 | 40.73 | 53.34 |
| AA459254 | 1211 | EST | 5.36 | 0.0259 | 403.69 | 194.85 | 401.21 | 51.84 | 43.51 | 37.57 |
| AA478556 | 1303 | EST | #N/A | #N/A | 172.35 | 135.55 | 120.49 | 143.25 | 134.62 | 109.1 |
| AA491208 | 1388 | chromosome 6 open reading frame 1 | 9.88 | #N/A | 159.88 | 143.86 | 80.49 | 123.37 | 131.81 | 47.97 |
| AA599585 | 1454 | EST | #N/A | #N/A | 66.17 | 48.91 | 48.12 | -12.47 | -17.55 | 21.82 |
| C21248 | 1585 | pituitary tumor-transforming 1 | 3.85 | 0.00456 | 100.24 | 96.81 | 47.17 | -1.7 | -11.27 | 28.49 |
| D20906 | 1627 | EST | 5.18 | 0.02189 | 210.11 | 151.67 | 185.24 | 14.87 | 11.71 | 27.2 |
| F02330 | 1778 | EST | #N/A | #N/A | 199.08 | 170.47 | 83.95 | 178.42 | 195.54 | 58.6 |
| F03811 | 1784 | KIAA0440 protein | #N/A | #N/A | 638.66 | 598.46 | 142.63 | 235.37 | 232.6 | 47.16 |
| F04531 | 1791 | Kell blood group precursor (McLeod phenotype) | 7.79 | 0.03205 | 311.05 | 366.72 | 262.03 | 16.22 | 20.65 | 13.52 |
| F09394 | 1803 | KIAA0715 protein | 22.89 | 0.01753 | 865.39 | 696.47 | 631.83 | -49.72 | -50.25 | 35.81 |
| H43646 | 1930 | H2A histone family, member Y | 4.6 | 0.00147 | 413.02 | 424.34 | 219.27 | 92.12 | 91.3 | 52.41 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| N49284 | 2536 | v-myb avian myeloblastosis viral oncogene homolog | 11.82 | 0.01981 | 510.82 | 523.45 | 423.41 | −36.17 | −50.08 | 50.71 |
| N54265 | 2562 | EST | #N/A | #N/A | 45.56 | 44.98 | 19.91 | 17.71 | 26.43 | 25.36 |
| N62675 | 2593 | DEAD/H (Asp-Glu-Ala-Asp/His) box polypeptide 16 | 3.61 | 0.04034 | 109.44 | 104.65 | 108.08 | 6.49 | 15.91 | 35.18 |
| N73846 | 2679 | EST | 3.27 | 0.00012 | 78.37 | 79.7 | 20.06 | 14.43 | 14.3 | 17.21 |
| N89670 | 2708 | EST | 4.26 | 0.00002 | 115.98 | 108.4 | 29.79 | 3.16 | −1.81 | 43.32 |
| N93798 | 2737 | protein tyrosine phosphatase type IVA, member 3 | 4.65 | 0.00118 | 557.51 | 523.56 | 229.03 | 139.69 | 122.61 | 84.93 |
| R33498 | 2819 | EST | 41.34 | 0.00001 | 1839.74 | 1920.41 | 1082.84 | 46.45 | 33.01 | 43.64 |
| R44479 | 2854 | KIAA0552 gene product | 4.14 | 0.0181 | 97.01 | 105.95 | 60.51 | 7.08 | 5.99 | 7.62 |
| R92994 | 2989 | matrix metalloproteinase 12 (macrophage elastase) | 11.05 | 0.00248 | 312.14 | 252.62 | 248.32 | 11.43 | 6.64 | 11.52 |
| R95966 | 2996 | EST | 11.22 | 0.00682 | 482.68 | 436.3 | 446.39 | −106.64 | −160.75 | 127.91 |
| T30222 | 3099 | EST | #N/A | #N/A | 35.41 | 34.75 | 27.14 | 8.47 | 9.56 | 17.71 |
| T32108 | 3102 | EST | 6.96 | 0.00723 | 1095.16 | 593.52 | 923.47 | 148.09 | 152.11 | 92.06 |
| T89601 | 3242 | EST | #N/A | #N/A | 839.07 | 747.51 | 231.92 | 410.07 | 342.22 | 200.88 |
| W46451 | 3526 | leukemia inhibitory factor (cholinergic differentiation factor) | #N/A | #N/A | 125.95 | 76.95 | 88.42 | 36.63 | 40.09 | 21.06 |
| W60968 | 3556 | EST | #N/A | #N/A | 125.7 | 144.72 | 48.22 | 51.99 | 55.29 | 21.11 |
| W93726 | 3653 | protease inhibitor 5 (maspin) | 16.48 | 0.00014 | 355.41 | 304.26 | 149.69 | −14.2 | −14.8 | 10.59 |
| W95477 | 3661 | EST | 26.51 | 0.00161 | 941.08 | 566.6 | 1130.33 | 17.15 | 18.75 | 12.83 |
| AA011134 | 29 | EST | 28.79 | 0.00602 | 1157.47 | 566.78 | 1448.16 | −72.57 | −51.2 | 69.3 |
| AA035540 | 81 | glutamate-cysteine ligase (gamma-glutamylcysteine synthetase), regulatory (30.8kD) | #N/A | #N/A | 39.84 | 34.37 | 13.29 | 13.59 | 12.27 | 8.96 |
| AA053033 | 124 | EST | 7.83 | 0.00379 | 212.61 | 135.28 | 160.82 | 3.41 | −1.28 | 19.74 |
| AA055805 | 132 | EST | 42.83 | 0.00142 | 1270.03 | 1026.97 | 1179.12 | −11.11 | −10.85 | 20.27 |
| AA055811 | 133 | glycoprotein A33 (transmembrane) | 6.86 | 0.02152 | 236.18 | 196.53 | 171.06 | 14.84 | 17.82 | 17.5 |
| AA131162 | 266 | EST | 4.68 | 0.00042 | 117.43 | 123.78 | 39.05 | 11.86 | 13.57 | 19.83 |
| AA157857 | 350 | keratin 19 | #N/A | #N/A | 2728.74 | 2917.98 | 1076.95 | −13.21 | −14.4 | 15.84 |
| AA252994 | 557 | apoptosis inhibitor 4 (survivin) | 3.55 | 0.00075 | 152.63 | 140.53 | 31.01 | 50.23 | 40.59 | 35.61 |
| AA258836 | 601 | WW domain binding protein 4 (formin binding protein 21) | #N/A | #N/A | 41.9 | 44.58 | 13.6 | 26.08 | 23.64 | 10.4 |
| AA291259 | 697 | putative G protein-coupled receptor | #N/A | #N/A | 112.28 | 45.1 | 113.44 | 1.53 | 1.88 | 6.06 |
| AA335191 | 741 | creatine kinase, brain | 47.35 | 0.00419 | 3540.65 | 3971.43 | 3135.19 | 43.84 | 33.21 | 43.52 |
| AA422086 | 938 | EST | 10.71 | 0.03418 | 828.27 | 598.22 | 800.79 | 39.48 | 34.98 | 23.29 |
| AA422150 | 939 | cytochrome P540 family member predicted from ESTs | 17.14 | 0.00108 | 664.26 | 609.99 | 475.91 | 28.76 | 27.53 | 22.47 |
| AA427460 | 972 | ATP-binding cassette, sub-family F (GCN20), member 2 | #N/A | #N/A | 215.08 | 135.22 | 216.95 | 92.5 | 83.63 | 49.3 |
| AA427636 | 976 | EST | 19.23 | 0.00145 | 511.98 | 500.83 | 299.69 | 6.19 | 3.7 | 15.84 |
| AA429890 | 1004 | cisplatin resistance associated | 12.51 | 0.00053 | 1225.72 | 590.09 | 992.47 | 90.02 | 67.23 | 59.35 |
| AA443316 | 1075 | v-Ha-ras Harvey rat sarcoma viral oncogene homolog | 4.13 | 0.01729 | 191.06 | 173.3 | 113.42 | 40.07 | 41.12 | 32.54 |
| AA599244 | 1448 | KIAA0530 protein | 3.39 | 0.01246 | 77.48 | 78.85 | 37.98 | 7.71 | 6.06 | 7.11 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA609013 | 1477 | dipeptidase 1 (renal) | 10.17 | 0.00109 | 1185.55 | 1222.89 | 634.13 | 114.31 | 98.91 | 75.22 |
| AA620497 | 1503 | EST | #N/A | #N/A | 147.72 | 165.83 | 66.02 | 95.91 | 76.7 | 80.33 |
| AA620995 | 1512 | EST | 3.74 | 0.03414 | 100.71 | 80.15 | 101.95 | 3.5 | 1.8 | 3.77 |
| C15078 | 1573 | EST | #N/A | #N/A | 115.08 | 73.82 | 91.34 | 26.22 | 31.14 | 60.2 |
| D80710 | 1734 | integral type I protein | 7.08 | 0.00213 | 253.6 | 303.7 | 149.08 | 22.95 | 28.29 | 24.59 |
| D80948 | 1738 | EST | #N/A | #N/A | 82.4 | 67.39 | 42.83 | 41.25 | 43.53 | 17.46 |
| F04320 | 1786 | replication factor C (activator 1) 4 (37kD) | 3.63 | 0.01119 | 90.37 | 115.96 | 49.41 | 14.92 | 17.26 | 9.79 |
| H03629 | 1834 | desmin | #N/A | #N/A | 52.19 | 58.52 | 35.47 | −1.96 | −2.94 | 8.58 |
| H11760 | 1878 | EST | #N/A | #N/A | 70.59 | 62.53 | 58.16 | 9.96 | 8.19 | 11.54 |
| H24269 | 1902 | E74-like factor 4 (ets domain transcription factor) | #N/A | #N/A | 51.79 | 47.58 | 24.25 | 15.19 | 16.8 | 12.36 |
| H57709 | 1956 | ribosomal protein L31 | #N/A | #N/A | 47.56 | 34.17 | 56.68 | 4.55 | 2.44 | 52.46 |
| H58873 | 1961 | solute carrier family 2 (facilitated glucose transporter), member 1 | 57.98 | 0.00063 | 4996.66 | 4603.55 | 4107.24 | 69.89 | 70.74 | 58.94 |
| H78211 | 2001 | EST | 6.73 | 0.02488 | 211.51 | 183.81 | 208.45 | −115.95 | −129.18 | 70.22 |
| N54395 | 2564 | EST | #N/A | #N/A | 49.95 | 46.84 | 48.26 | −16.14 | −17.71 | 6.65 |
| N92734 | 2721 | EST | #N/A | #N/A | 45.63 | 39.49 | 14.19 | 27.31 | 25.45 | 10.41 |
| R06251 | 2763 | tumor protein D52-like 2 | 5.57 | 0.00037 | 343.86 | 381.79 | 95.11 | 74.25 | 66.72 | 64.11 |
| R27296 | 2806 | EST | #N/A | #N/A | 41.82 | 39.83 | 32.72 | 8.27 | 11.07 | 7.26 |
| R36947 | 2824 | calcium channel, voltage-dependent, beta 3 subunit | 4.11 | 0.00006 | 101.82 | 109.62 | 28.57 | −0.61 | 0.94 | 37.6 |
| R96924 | 3000 | EST | 6.18 | 0.03417 | 451.59 | 490.51 | 339.66 | 51.01 | 52.94 | 54.09 |
| T15473 | 3057 | muscle specific gene | 5.81 | 0.02404 | 189.25 | 139.11 | 184.39 | −5.65 | −10.77 | 15.89 |
| T16983 | 3073 | cleavage and polyadenylation specific factor 4, 30kD subunit | 5.23 | 0.00075 | 268.21 | 300.53 | 81.43 | 65.64 | 45.67 | 74.28 |
| T30193 | 3097 | protease, serine, 8 (prostasin) | 8.39 | 0.00043 | 1912.22 | 1228.46 | 1739.5 | 214.88 | 175.57 | 127.28 |
| T47601 | 3125 | EST | 4.05 | 0.00878 | 199.79 | 219.84 | 62.16 | 84.5 | 28.33 | 122.16 |
| T66935 | 3178 | EST | 3.97 | 0.00188 | 253.93 | 230.32 | 129.66 | 66.8 | 52.94 | 42.32 |
| W73189 | 3586 | EphB2 | 3.69 | 0.02909 | 113.63 | 144.75 | 67.73 | 20.7 | 23.2 | 15.44 |
| D13435 | 1605 | phosphatidylinositol glycan, class F | #N/A | #N/A | 80.8 | 88.58 | 41.56 | 34.85 | 41.76 | 18.11 |
| D14520 | 1613 | basic transcription element binding protein 2 | 4.93 | 0.00004 | 151.12 | 135.19 | 57.24 | 25.67 | 17.28 | 25.67 |
| D21063 | 1628 | minichromosome maintenance deficient (S. cerevisiae) 2 (mitotin) | 3.83 | 0.00983 | 91.18 | 55.12 | 60.89 | −51.33 | −62.63 | 28.4 |
| D50914 | 1673 | KIAA0124 protein | 4.74 | 0.00752 | 116.55 | 91.64 | 89.27 | −17.4 | −17.86 | 16.97 |
| 063486 | 1712 | KIAA0152 gene product | 6.33 | 0.00078 | 543.91 | 676.55 | 287.16 | 84.6 | 95.61 | 45.48 |
| D63880 | 1715 | KIAA0159 gene product | 4.26 | 0.00253 | 93.03 | 103.26 | 41.4 | −2.12 | −4.45 | 9.38 |
| D79992 | 1724 | KIAA0170 gene product | #N/A | #N/A | 35.23 | 42.16 | 14.88 | 22 | 18.09 | 11.9 |
| D79997 | 1725 | KIAA0175 gene product | #N/A | #N/A | 55.25 | 42.49 | 53.87 | 8.57 | 6.15 | 13.07 |
| D83735 | 1747 | calponin 2 | 10.42 | 0.00001 | 486.85 | 436.55 | 172.25 | 42.54 | 43.06 | 57.58 |
| D84557 | 1749 | minichromosome maintenance deficient (mis5, S. pombe) 6 | #N/A | #N/A | 142.92 | 125.75 | 102.81 | 37.22 | 43.12 | 28.15 |
| D87073 | 1759 | zinc finger protein 142 (clone pHZ-49) | #N/A | #N/A | 40.84 | 34.37 | 13.36 | 33.34 | 33.07 | 21.13 |
| J04469 | 2111 | creatine kinase, mitochondrial 1 (ubiquitous) | 7.9 | 0.00705 | 212.04 | 143.89 | 162.12 | −17.21 | −18.81 | 12.68 |
| J05257 | 2118 | dipeptidase 1 (renal) | 12.02 | 0.02099 | 429.91 | 300.76 | 352.56 | −21.05 | −21.78 | 30.67 |
| J05272 | 2119 | IMP (inosine monophosphate) dehydrogenase 1 | #N/A | #N/A | 269.89 | 205 | 173.64 | 126.69 | 106.27 | 82.73 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| L07597 | 2146 | ribosomal protein S6 kinase, 90kD, polypeptide 1 | #N/A | #N/A | 36.09 | 29.39 | 44.43 | -12.04 | -10.72 | 11.97 |
| L11669 | 2157 | tetracycline transporter-like protein | 6.75 | 0.00101 | 218.77 | 261.77 | 115.8 | 26.26 | 25.92 | 17.48 |
| L23808 | 2179 | matrix metalloproteinase 12 (macrophage elastase) | 6.18 | 0.02195 | 175.24 | 161.83 | 132.75 | -9.99 | -8.2 | 8.11 |
| L35035 | 2201 | ribose 5-phosphate isomerase A (ribose 5-phosphate epimerase) | #N/A | #N/A | 64.36 | 69.69 | 40.9 | 11.52 | 12.58 | 6.43 |
| L35545 | 2202 | endothelial cell protein C/activated protein C receptor | #N/A | #N/A | 66.65 | 55.46 | 68.13 | 7.75 | 5.68 | 11.48 |
| L38696 | 2208 | RNA-binding protein (autoantigenic) | 3.7 | 0.00093 | 230.48 | 161.69 | 118.85 | 60.18 | 58.55 | 24.77 |
| L41351 | 2214 | protease, serine, 8 (prostasin) | 6.34 | 0.01132 | 214.13 | 104.95 | 189.28 | 10.88 | 9.6 | 22.68 |
| M15205 | 2265 | thymidine kinase 1, soluble | 3.75 | 0.00159 | 153.15 | 150.31 | 66.27 | 41.98 | 35.02 | 29.02 |
| M18728 | 2285 | carcinoembryonic antigen-related cell adhesion molecule 6 (non-specific cross reacting antigen) | 44.82 | 0.00291 | 1390.62 | 1362.73 | 1031.01 | -9.17 | -13.17 | 11.83 |
| M25629 | 2307 | kallikrein 1, renal/pancreas/salivary | #N/A | #N/A | 47.43 | 40.22 | 29.15 | -2.42 | 2.12 | 15.6 |
| M27826 | 2313 | endogenous retroviral protease | 26.36 | 0.00342 | 993.89 | 833.56 | 816.33 | 5.88 | 7.04 | 32.2 |
| M29540 | 2317 | carcinoembryonic antigen-related cell adhesion molecule 5 | 36.57 | 0.0116 | 1516.55 | 1083.69 | 1372.55 | -1.09 | -3.15 | 11.75 |
| M87339 | 2414 | replication factor C (activator 1) 4 (37kD) | 4.07 | 0.00316 | 93.72 | 78.1 | 56.58 | 4.26 | 9.92 | 16.79 |
| M94250 | 2425 | midkine (neurite growth-promoting factor 2) | 10.39 | 0.01818 | 442.2 | 188.32 | 624.9 | -155.4 | -175.43 | 101.89 |
| M94345 | 2426 | capping protein (actin filament), gelsolin-like | 22.38 | 0.00003 | 503.47 | 539.15 | 179.05 | -7.51 | -10.35 | 22.75 |
| M94362 | 2427 | lamin B2 | #N/A | #N/A | 175.16 | 154.32 | 75.52 | 79.2 | 81.73 | 34.64 |
| M95623 | 2430 | hydroxymethylbilane synthase | #N/A | #N/A | 67.65 | 72.44 | 22.29 | 6.67 | 0.88 | 24.92 |
| S78187 | 3035 | cell division cycle 25B | 8.07 | 0.00009 | 198.51 | 218.04 | 74.52 | 3.36 | -1.2 | 26.9 |
| U01062 | 3272 | inositol 1,4,5-triphosphate receptor, type 3 | 7.41 | 0 | 160.46 | 164.36 | 23.91 | -16.8 | -26.61 | 26.44 |
| U01147 | 3274 | active BCR-related gene | 3.22 | 0.00103 | 97.43 | 84.12 | 41.43 | 27.15 | 22.94 | 17 |
| U03398 | 3281 | tumor necrosis factor (ligand) superfamily, member 9 | #N/A | #N/A | 116.17 | 88.07 | 59.5 | 115.08 | 92.7 | 93.14 |
| U04313 | 3283 | protease inhibitor 5 (maspin) | 4.54 | 0.02986 | 132.77 | 69.67 | 115.99 | -0.34 | -2.59 | 9.7 |
| U16306 | 3311 | chondroitin sulfate proteoglycan 2 (versican) | #N/A | #N/A | 48.35 | 56.91 | 35.99 | 8.07 | 4.58 | 16.58 |
| U17760 | 3314 | laminin, beta 3 (nicein (125kD), kalinin (140kD), BM600 (125kD)) | 3.54 | 0.01853 | 103.13 | 111.96 | 72.83 | 6.99 | -3.15 | 21.08 |
| U21049 | 3324 | epithelial protein up-regulated in carcinoma, membrane associated protein 17 | 7.53 | 0.01667 | 202.38 | 248.15 | 119.31 | -14.32 | -12.21 | 19.43 |
| U38847 | 3356 | TAR (HIV) RNA-binding protein 1 | #N/A | #N/A | 72.74 | 66.76 | 36.14 | 15.7 | 17.43 | 10.2 |
| U40990 | 3358 | potassium voltage-gated channel, KQT-like subfamily, member 1 | 3.18 | 0.00093 | 128.02 | 142.31 | 43.16 | 40.88 | 42.64 | 23.09 |
| U51095 | 3381 | caudal type homeo box transcription factor 1 | 4.76 | 0.02664 | 130.81 | 143.82 | 93.4 | 5.83 | 5.55 | 8.97 |
| U53786 | 3389 | envoplakin | #N/A | #N/A | 221.51 | 73.95 | 249.37 | -20.54 | -20.08 | 16.22 |
| U66661 | 3405 | gamma-aminobutyric acid (GABA) A receptor, epsilon | #N/A | #N/A | 55.33 | 44.93 | 29.26 | 16.58 | 14.81 | 11.96 |
| U77413 | 3426 | O-linked N-acetylglucosamine (GlcNAc) transferase (UDP-N-acetylglucosamine;polypeptide-N-acetylglucosaminyl transferase) | #N/A | #N/A | 59.38 | 59.78 | 48.05 | 1.2 | 5.23 | 13.8 |
| U89606 | 3451 | pyridoxal (pyridoxine, vitamin B6) kinase | 3.58 | 0.00322 | 103.6 | 97.56 | 58.85 | 15.19 | 18.94 | 24.5 |

TABLE 9A-continued

Genes and ESTs expressed only in Metastatic Liver Tumor vs Normal2

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| X13956 | 3698 | EST | 3.2 | 0.00321 | 79.19 | 75.13 | 39.53 | 15.11 | 18.02 | 14.55 |
| X14850 | 3703 | H2A histone family, memberX | 4.11 | 0.0001 | 118.41 | 97.53 | 52.6 | 11.6 | 13.26 | 30.46 |
| | | v-abl Abelson murine leukemia viral oncogene | | | | | | | | |
| X16416 | 3710 | homolog 1 | #N/A | #N/A | 82.49 | 90.74 | 16.7 | 36.59 | 38 | 14.59 |
| X57766 | 3742 | matrix metalloproteinase 11 (stromelysin 3) | #N/A | #N/A | 166.25 | 142.96 | 124.34 | 63.38 | 62.13 | 25.48 |
| X63629 | 3759 | cadherin 3, P-cadherin (placental) | 3.02 | 0.01654 | 67.22 | 76.67 | 29.17 | -4.24 | -6.82 | 16.9 |
| X67325 | 3772 | interferon, alpha-inducible protein 27 | 9.67 | 0.03245 | 962.87 | 412.22 | 1361.55 | 26.81 | 48.73 | 69.77 |
| X76180 | 3792 | sodium channel, nonvoltage-gated 1 alpha | 11.68 | 0 | 320.05 | 268.84 | 127.86 | 22.38 | 23.9 | 15.02 |
| | | FXYD domain-containing ion transport regulator | | | | | | | | |
| X93036 | 3827 | 3 | 42.36 | 0.00167 | 1322.91 | 783.61 | 1219 | -83.87 | -85.84 | 40.53 |
| Y00503 | 3846 | keratin 19 | 14.19 | 0.00217 | 362.5 | 427.85 | 240.73 | 7.02 | 10.74 | 10.98 |
| | | SRY (sex-determining region Y)-box 9 (campomelic dysplasia, autosomal sex- | | | | | | | | |
| Z46629 | 3935 | reversal) | #N/A | #N/A | 39.69 | 40.61 | 13.99 | 6.21 | 8.06 | 9.16 |
| | | lectin, galactoside-binding, soluble, 9 (galectin | | | | | | | | |
| AB006782 | 1541 | 9) | #N/A | #N/A | 475.47 | 430.44 | 192.68 | 222.25 | 213.37 | 51.25 |
| X83228 | 3807 | cadherin 17, LI cadherin (liver-intestine) | 10.58 | 0.02147 | 342.12 | 423.87 | 282.49 | -8.87 | -6.9 | 8.55 |
| | | HMT1 (hnRNP methyltransferase, S. | | | | | | | | |
| Y10807 | 3857 | cerevisiae)-like 2 | 4.28 | 0.00124 | 393.27 | 449.97 | 142.94 | 96 | 90.42 | 44.52 |
| U48705 | 3369 | discoidin domain receptor family, member 1 | 5.94 | 0.01323 | 178.04 | 200.63 | 102.82 | -1.87 | -6.25 | 25.81 |
| | | small nuclear ribonucleoprotein 70kD | | | | | | | | |
| X04654 | 3678 | polypeptide (RNP antigen) | #N/A | #N/A | 98.11 | 89.35 | 38.15 | 42.22 | 41.24 | 17.18 |
| | | CD44 antigen (homing function and India | | | | | | | | |
| HG2981-HT3127 | | blood group system) | #N/A | #N/A | 48.43 | 47.46 | 47.03 | 8.05 | 9.25 | 7.17 |
| HG371-HT26388 | | mucin 1, transmembrane | 8.44 | 0.00268 | 310.61 | 203.35 | 303.26 | 19.1 | 2.63 | 34.66 |
| J05582 | 2121 | mucin 1, transmembrane | 5.39 | 0.00056 | 114 | 114.74 | 42.09 | -6.01 | -4.53 | 13.68 |
| M16364 | 2269 | creatine kinase, brain | 12.69 | 0.03633 | 683.38 | 491.19 | 929.94 | -72.18 | -70.9 | 40.37 |
| X54667 | 3728 | cystatin S, cystatin SN | 8.53 | 0.00059 | 273.96 | 169.94 | 217.11 | -10.09 | -15.68 | 74.89 |
| M29277 | 2316 | melanoma adhesion molecule | 3.91 | 0.00112 | 269.54 | 313.13 | 82.76 | 80.09 | 81.21 | 48.32 |
| X57348 | 3741 | stratifin | 12.53 | 0.0013 | 308.28 | 241.69 | 194.79 | -63.66 | -76.43 | 44.95 |
| U07969 | 3288 | cadherin 17, LI cadherin (liver-intestine) | 10.78 | 0.02002 | 428.65 | 383.68 | 390.23 | 15.78 | 12.82 | 12.06 |
| M12125 | 2241 | tropomyosin 2 (beta) | 10.83 | 0.00191 | 291.63 | 158.55 | 229.08 | 13.01 | 16.33 | 11.64 |
| | | transcription factor 3 (E2A immunoglobulin | | | | | | | | |
| M31523 | 2329 | enhancer binding factors E12/E47) | #N/A | #N/A | 59.78 | 62.53 | 10.63 | 18.65 | 21.63 | 8.94 |
| X99133 | 3839 | lipocalin 2 (oncogene 24p3) | 6.27 | 0.0453 | 284.56 | 129.1 | 434.01 | -28.39 | -19.41 | 26.24 |
| | | sulfotransferase family 1A, phenol-preferring, | | | | | | | | |
| U20499 | 3320 | member 3 | 5.5 | 0.00299 | 316.7 | 231.67 | 222.02 | 48.34 | 54.37 | 24.69 |
| L42583 | 2215 | keratin 6A | #N/A | #N/A | 116.33 | 111.15 | 91.3 | 60.92 | 51.12 | 22.52 |

TABLE 9B

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA027766 | 58 | microvascular endothelial differentiation gene 1 | #N/A | #N/A | 16.71 | 16.37 | 7.36 | 25.05 | 26.19 | 13.26 |
| AA028976 | 63 | EST | #N/A | #N/A | 9.46 | 10.28 | 18.91 | 72.06 | 47.28 | 55.89 |
| AA041208 | 96 | NADH dehydrogenase (ubiquinone) 1 beta subcomplex, 8 (19kD, ASHI) | #N/A | #N/A | 234.76 | 302.34 | 215.51 | 448.34 | 390 | 234.61 |
| AA044095 | 102 | EST | #N/A | #N/A | 29.41 | 18.4 | 35.04 | 31.85 | 24.92 | 38.98 |
| AA044842 | 105 | Autosomal Highly Conserved Protein | 5.21 | 0.0009 | 16.66 | 16.52 | 18 | 167.15 | 159.32 | 123.77 |
| AA047151 | 116 | EST | 7.13 | 0.00007 | 17.55 | 17.5 | 10.09 | 188.62 | 185.41 | 80.5 |
| AA056319 | 139 | EST | #N/A | #N/A | 21.89 | 17.62 | 12.89 | 29.23 | 26.53 | 11.96 |
| AA092376 | 196 | 15 kDa selenoprotein | #N/A | #N/A | 16.78 | 14.2 | 28.1 | 59.07 | 57.94 | 24.97 |
| AA092596 | 197 | bone morphogenetic protein 6 | 3.46 | 0.02532 | 30.18 | 22.69 | 61.67 | 148.47 | 171.15 | 77.57 |
| AA092716 | 198 | HLA-B associated transcript-3 | 13.97 | 0.00009 | 62.83 | 63.53 | 42.33 | 952.09 | 817.41 | 545.31 |
| AA143019 | 309 | EST | 6.75 | 0.00009 | -0.4 | -5.82 | 18.62 | 192.42 | 176.13 | 136.81 |
| AA157401 | 346 | S-adenosylhomocysteine hydrolase-like 1 | #N/A | #N/A | 15.44 | 13.27 | 14.06 | 61.17 | 65.58 | 27.48 |
| AA174202 | 375 | EST | #N/A | #N/A | 55.99 | 38.87 | 72.55 | 120.99 | 128.88 | 62.33 |
| AA195179 | 415 | eukaryotic translation initiation factor 4A, isoform 2 | #N/A | #N/A | 30.71 | 38.24 | 25.48 | 85.7 | 87.87 | 42.11 |
| AA233225 | 468 | MRS1 protein | #N/A | #N/A | 25.16 | 30.66 | 26.03 | 54.1 | 55.8 | 22.69 |
| AA234634 | 486 | CCAAT/enhancer binding protein (C/EBP), delta | 7.48 | 0.03318 | 158.16 | 49.12 | 223.12 | 621.92 | 588.94 | 332.64 |
| AA234687 | 487 | EST | #N/A | #N/A | -8.8 | -12.38 | 20.12 | 61.87 | 47.79 | 57.62 |
| AA234817 | 490 | EST | 6.22 | 0.00099 | 31.51 | 20.97 | 34.92 | 222.41 | 156.99 | 133.06 |
| AA247453 | 533 | EST | 3.09 | 0.0015 | 32.38 | 37.86 | 21.04 | 120.43 | 133.44 | 58.12 |
| AA292440 | 709 | DKFZP566B133 protein | #N/A | #N/A | 122.1 | 125.27 | 37.73 | 370.32 | 318.31 | 181.37 |
| AA296821 | 723 | EST | #N/A | #N/A | 15.47 | 10.65 | 21.91 | 57.72 | 71.28 | 33.61 |
| AA298180 | 726 | EST | 3.11 | 0.00747 | 19.6 | 25.9 | 18.83 | 109.91 | 84.28 | 88.07 |
| AA316672 | 734 | fatty-acid-Coenzyme A ligase, long-chain 3 | #N/A | #N/A | 34.62 | 38.08 | 17.08 | 71.9 | 73.01 | 27.47 |
| AA328684 | 737 | EST | #N/A | #N/A | 49.88 | 48.15 | 31.41 | 115.97 | 114.66 | 46.25 |
| AA397841 | 780 | EST | 8.21 | 0 | 7.72 | 3.33 | 18.47 | 214.17 | 189.93 | 116.41 |
| AA400333 | 815 | tumor necrosis factor alpha-inducible cellular protein containing leucine zipper domains; Huntingtin interacting protein L; transcription factor IIIA-interacting protein | #N/A | #N/A | 27.22 | 27.33 | 24.37 | 62.54 | 58.6 | 31.69 |
| AA404214 | 846 | EST | #N/A | #N/A | 35.28 | 48.54 | 23.52 | 70.66 | 66.71 | 55.97 |
| AA424307 | 944 | EST | 5.73 | 0.0074 | 44.98 | 21.05 | 54.01 | 202.82 | 194.92 | 68.07 |
| AA447876 | 1109 | EST | #N/A | #N/A | 13.05 | 6.78 | 34.07 | 27.08 | 22.86 | 22.46 |
| AA456687 | 1197 | EST | 3.08 | 0.01189 | 17.88 | 37.03 | 53.32 | 130.65 | 118.55 | 65.44 |
| AA479266 | 1312 | EST | #N/A | #N/A | 18.04 | 21.7 | 25.73 | 42.53 | 38.32 | 18.46 |
| AB000114 | 1532 | osteomodulin | #N/A | #N/A | -2.62 | -0.81 | 29.14 | 31.94 | 25.4 | 20.87 |
| AF007216 | 1550 | solute carrier family 4, sodium bicarbonate cotransporter, member 4 | 5.79 | 0.00005 | 14.85 | 9.84 | 13.93 | 157.72 | 162.44 | 99.26 |
| C02532 | 1563 | EST | #N/A | #N/A | 10.12 | 16.41 | 16.79 | 32.27 | 34.25 | 11.02 |
| C15871 | 1575 | EST | 3.26 | 0.00046 | 13.83 | 18.19 | 16.99 | 79.77 | 83.41 | 40.17 |
| C16420 | 1576 | EST | 5.95 | 0.00119 | 26.92 | 20.84 | 24.82 | 205.53 | 234.17 | 120.92 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| C18029 | 1577 | tumor susceptibility gene 101 | #N/A | #N/A | 27.46 | 26.72 | 26.09 | 94.81 | 95.79 | 33.89 |
| D12620 | 1601 | cytochrome P450, subfamily IVF, polypeptide 2, cytochrome P450, subfamily IVF, polypeptide 3 (leukotriene B4 omega hydroxylase) | 35.09 | 0.00015 | 41.08 | 36.71 | 10.11 | 604.7 | 631.98 | 249.32 |
| D13243 | 1602 | pyruvate kinase, liver and RBC | 20.22 | 0 | −35.85 | −34.85 | 51.7 | 579.28 | 445.53 | 502 |
| D14012 | 1612 | HGF activator | 12.75 | 0.0035 | 160.15 | 216.05 | 107.03 | 1705.96 | 1963.23 | 794.42 |
| D16626 | 1622 | histidine ammonia-lyase | 22.66 | 0 | 11.74 | 8.13 | 16.04 | 538.78 | 535.2 | 166.14 |
| D16626 | 1622 | histidine ammonia-lyase | 22.66 | 0 | 12.06 | 22.91 | 55.95 | 289.6 | 256.22 | 113.59 |
| D45288 | 1661 | EST | #N/A | #N/A | −33.07 | 27.77 | 31.63 | 32.56 | 42.02 | |
| D50312 | 1669 | potassium inwardly-rectifying channel, subfamily J, member 8 | #N/A | #N/A | −2.39 | 3.94 | 24.71 | 76.55 | 72.56 | 48.96 |
| D57823 | 1690 | Sec23 (S. cerevisiae) homolog A | 4.43 | 0 | 13.37 | 13.08 | 8.38 | 94.25 | 87.66 | 30.56 |
| D57916 | 1691 | EST | #N/A | #N/A | 67.05 | 42.08 | 79.49 | 126.25 | 103.85 | 69.38 |
| D61991 | 1706 | EST | 4.84 | 0.00005 | 22.03 | 21.01 | 10.8 | 131.66 | 150.48 | 60.06 |
| D62103 | 1707 | EST | 4.11 | 0.0263 | 96.52 | 111.02 | 79.07 | 349.4 | 258.95 | 229.11 |
| H19089 | 1894 | EST | #N/A | #N/A | 76.83 | 44.82 | 89.14 | 76.54 | 74.4 | 40.21 |
| H20627 | 1898 | EST | #N/A | #N/A | 30.59 | 30.04 | 23.84 | 79.8 | 87.46 | 43.37 |
| H39627 | 1920 | EST | #N/A | #N/A | 73.92 | 101.48 | 54.09 | 155.43 | 158.44 | 39.98 |
| H61002 | 1967 | EST | #N/A | #N/A | 68.96 | 23.38 | 102.25 | 88.87 | 93.79 | 36.34 |
| H66367 | 1977 | EST | 6.68 | 0.0001 | −5.44 | −2.13 | 18.66 | 155.38 | 149.31 | 70.77 |
| H72650 | 1994 | EST | #N/A | #N/A | 81.21 | 98.79 | 41.38 | 122 | 125 | 42.24 |
| J00098 | 2086 | apolipoprotein A-I, apolipoprotein C-III | #N/A | #N/A | 96.71 | 29.74 | 269.46 | 9836.26 | 8356.89 | 8217.05 |
| K03192 | 2127 | cytochrome P450, subfamily IIA (phenobarbital-inducible), polypeptide 6 cytochrome P450, subfamily IIA | 69.92 | 0 | 3.07 | 9.83 | 30.14 | 1767.25 | 1790.36 | 741.7 |
| K03192 | 2127 | (phenobarbital-inducible), polypeptide 6 | 69.92 | 0 | −1.32 | −6.49 | 12.52 | 1087.08 | 1034.79 | 451.92 |
| L11244 | 2155 | complement component 4-binding protein, beta | 43.33 | 0 | 0.49 | −8.84 | 36.95 | 1147.16 | 1114.71 | 441.14 |
| L11244 | 2155 | complement component 4-binding protein, beta | 43.33 | 0 | −13.27 | −16.78 | 12.92 | 292.9 | 341.12 | 114.93 |
| L26336 | 2185 | heat shock 70kD protein 2 | #N/A | #N/A | 15.67 | 14.08 | 10.72 | 31.12 | 33.86 | 10.1 |
| L41067 | 2213 | nuclear factor of activated T-cells, cytoplasmic 3 | 4.96 | 0.00473 | 57.54 | 60.41 | 36.65 | 261.77 | 228.95 | 119.65 |
| L41067 | 2213 | nuclear factor of activated T-cells, cytoplasmic 3 | 4.96 | 0.00473 | 30.25 | 13.66 | 32.44 | 73.87 | 77.38 | 52.02 |
| L44424 | 2216 | UMP-CMP kinase | #N/A | #N/A | 23.79 | 18.2 | 26.85 | 57.57 | 43.3 | 36.92 |
| M12712 | 2246 | protein C (inactivator of coagulation factors Va and VIIIa) | 7.37 | 0.01866 | 107.12 | 177.74 | 113.63 | 646.94 | 628.19 | 326.15 |
| M12759 | 2247 | EST | #N/A | #N/A | 27.23 | 21.91 | 28.99 | 97.65 | 103.06 | 53.91 |
| M14777 | 2263 | glutathione S-transferase A2, glutathione S-transferase A3 | #N/A | #N/A | −24.81 | −27.52 | 27.54 | 2842.35 | 2790.19 | 1048.69 |
| M16974 | 2277 | complement component 8, alpha polypeptide | 49.47 | 0.00046 | 28.24 | −6.62 | 84.02 | 1843.82 | 1920.94 | 524.62 |
| M26393 | 2309 | acyl-Coenzyme A dehydrogenase, C-2 to C-3 short chain | 16.27 | 0.00007 | 16.81 | 12.39 | 48.16 | 677.3 | 775.54 | 358.47 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| M30185 | 2321 | cholesteryl ester transfer protein, plasma | 3.83 | 0.0013 | −37.15 | −29.18 | 28.09 | 93.07 | 86.04 | 61.35 |
| M61854 | 2370 | cytochrome P450, subfamily IIC (mephenytoin 4-hydroxylase) | 3.3 | 0.04185 | 52.7 | 55.56 | 44.01 | 321.6 | 166.36 | 430.71 |
| M95767 | 2431 | chitobiase, di-N-acetyl- | 4.94 | 0.00004 | 26.01 | 37.13 | 21.53 | 173.07 | 153.03 | 95 |
| N27670 | 2473 | progesterone membrane binding protein | 6.15 | 0.00321 | 38.66 | 15.48 | 47.19 | 252.94 | 292.34 | 133.48 |
| N40320 | 2513 | EST | 7.56 | 0.01584 | 99.72 | 83.43 | 128.45 | 558.37 | 595.16 | 250.67 |
| N57464 | 2575 | CCAAT/enhancer binding protein (C/EBP), delta | 14.69 | 0.00018 | 22.28 | 11.43 | 38.78 | 429.29 | 442.58 | 169.83 |
| N75120 | 2689 | EST | #N/A | #N/A | 20.59 | 23.42 | 10.65 | 61.42 | 58.88 | 13.84 |
| N87590 | 2706 | EST | #N/A | #N/A | 1.04 | −3.72 | 9.99 | 64.67 | 59.2 | 35.53 |
| N94146 | 2738 | EST | 8.05 | 0 | 28.92 | 34.7 | 14.14 | 258.82 | 265.55 | 101.53 |
| N99542 | 2746 | orosomucoid 1 | 8.41 | 0.00001 | 6.74 | 10.14 | 21.89 | 226.06 | 187.68 | 146.11 |
| R19808 | 2795 | EST | #N/A | #N/A | 9.95 | 12.2 | 25.55 | 27.53 | 25.43 | 10.61 |
| R31641 | 2813 | EST | 9.96 | 0.00011 | 29.02 | 21.83 | 31.18 | 350.89 | 330.68 | 166.29 |
| R63545 | 2926 | EST | 5.4 | 0.00202 | 2.58 | 9.54 | 17.4 | 157.98 | 128.33 | 139.55 |
| R64534 | 2933 | EST | #N/A | #N/A | 12.11 | 14.54 | 5.77 | 40.32 | 40.98 | 17.27 |
| R71459 | 2952 | differentially expressed in adenocarcinoma of the lung | #N/A | #N/A | 16.9 | 11.46 | 16.47 | 37.42 | 30.98 | 20.83 |
| R77539 | 2964 | EST | #N/A | #N/A | 5.91 | 14.55 | 25.48 | 70.5 | 59.8 | 31.72 |
| R82229 | 2974 | phosphatidylserine decarboxylase | 3.08 | 0.03455 | 84.63 | 80.61 | 67.01 | 228.19 | 232.06 | 58.36 |
| R98073 | 3008 | EST | 46.87 | 0 | −4.33 | −9.52 | 11.43 | 1161.51 | 1291.95 | 564.26 |
| S62539 | 3021 | insulin receptor substrate 1 | 3.7 | 0.01307 | 28.26 | 13.05 | 40.92 | 132.59 | 97.52 | 103.35 |
| S72370 | 3029 | pyruvate carboxylase | 5.31 | 0.00075 | 3.83 | 5.81 | 23.1 | 113.03 | 118.49 | 50.19 |
| T08879 | 3048 | cathepsin F | 5.29 | 0.0008 | 17.98 | 14.06 | 12.92 | 156.33 | 180.88 | 79.67 |
| T57140 | 3151 | paraoxonase 3 | 28.8 | 0 | −1.37 | −7.55 | 22.26 | 825.16 | 979.66 | 487.32 |
| T68083 | 3184 | short-chain dehydrogenase/reductase 1 | 4.03 | 0.01593 | 65.11 | 47.59 | 67.87 | 263.22 | 280.22 | 136.48 |
| T68510 | 3186 | EST | 3.87 | 0.00617 | 0.88 | −1.97 | 11.33 | 113.31 | 94.26 | 103.92 |
| T69384 | 3197 | phytanoyl-CoA hydroxylase (Refsum disease) | 5.88 | 0.01219 | 37.94 | 19.8 | 90.03 | 232.84 | 205.78 | 126.44 |
| T83397 | 3232 | KIAA1051 protein | 63.6 | 0 | −17.97 | −4.64 | 35.51 | 1404.6 | 1421.69 | 605.99 |
| T95813 | 3261 | UDP glycosyltransferase 2 family, polypeptide B15 | 38.38 | 0.00008 | 56.83 | 42.22 | 56.86 | 2271.29 | 1809.29 | 1537.82 |
| U06641 | 3286 | follistatin-like 1 | 24.32 | 0.00001 | 56.39 | 62.92 | 54.9 | 1762.46 | 1615.25 | 1206.06 |
| U06863 | 3287 | apolipoprotein C-IV | 3.09 | 0.00091 | 43.48 | 45.73 | 14.83 | 141.97 | 149.4 | 59.45 |
| U32576 | 3346 | apolipoprotein C-IV | 18.59 | 0.00005 | 311.97 | 318.75 | 271.42 | 1299.4 | 1145.33 | 698.02 |
| U32576 | 3346 | myosin VIIA (Usher syndrome 1B (autosomal recessive, severe)) | 18.59 | 0.00005 | −7.01 | −23.2 | 62.7 | 606.88 | 608.66 | 224.72 |
| U39226 | 3357 | deoxyribonuclease 1-like 3 | #N/A | #N/A | 33.54 | 31.07 | 8.59 | 53.24 | 50.47 | 20.86 |
| U56814 | 3392 | dermatan sulphate proteoglycan 3 | 29.43 | 0.00003 | 5.04 | 11.75 | 22.3 | 853.78 | 1073.24 | 434.79 |
| U59111 | 3396 | ATP-binding cassette, sub-family A (ABC1), member 5 | #N/A | #N/A | 32.34 | 26.73 | 15.11 | 68.69 | 64.44 | 32.48 |
| U66672 | 3406 | glutamic-pyruvate transaminase (alanine aminotransferase) | #N/A | #N/A | 78.03 | 41.24 | 72.76 | 105.45 | 97.64 | 60.15 |
| U70732 | 3414 | glutamic-pyruvate transaminase (alanine aminotransferase) | 27.63 | 0 | −47.95 | −65.21 | 50.88 | 696.22 | 732.8 | 284.7 |
| U70732 | 3414 | glutamic-pyruvate transaminase (alanine aminotransferase) | 27.63 | 0 | −1.44 | 3.98 | 66.42 | 201.88 | 218.68 | 136.17 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| U82108 | 3440 | solute carrier family 9 (sodium/hydrogen exchanger), isoform 3 regulatory factor 2 | 3.19 | 0.01545 | 58.61 | 78.15 | 43.49 | 130.34 | 122.39 | 73.74 |
| U95090 | 3463 | nephrosis 1, congenital, Finnish type (nephrin) | 14.01 | 0.00018 | 40.49 | 30.15 | 38.71 | 554.93 | 539.41 | 183.55 |
| U95090 | 3463 | nephrosis 1, congenital, Finnish type (nephrin) | 14.01 | 0.00018 | 4.97 | 5.87 | 18.32 | 188.83 | 201.08 | 88.01 |
| W02027 | 3464 | EST | #N/A | #N/A | 7.28 | 2.64 | 14.09 | 30.56 | 28.52 | 12.47 |
| W03796 | 3467 | EST | 8.3 | 0.0032 | 8.13 | −19.16 | 75.11 | 336.51 | 383.56 | 190.14 |
| W16686 | 3475 | basic helix-loop-helix domain containing, class B, 2 | #N/A | #N/A | 46.29 | −6.45 | 123.94 | 100.9 | 83.13 | 79.01 |
| W27503 | 3485 | KIAA0679 protein | #N/A | #N/A | 17.31 | 17.31 | 21.95 | 27.71 | 27.51 | 5.28 |
| W28235 | 3486 | EST | #N/A | #N/A | 95.97 | 150.37 | 81.4 | 271.36 | 307.26 | 108.42 |
| W28824 | 3492 | EST | 15.8 | 0.00006 | −1.99 | −5.59 | 17.64 | 441.67 | 509.29 | 251 |
| W36290 | 3500 | Kreisler (mouse) maf-related leucine zipper homolog | 3.94 | 0.02718 | 48.52 | 10.45 | 73.21 | 157.7 | 156.24 | 65.15 |
| W38778 | 3504 | EST | #N/A | #N/A | −55.97 | −63.87 | 44.35 | 78.01 | 37.07 | 137.01 |
| W52581 | 3540 | CD36 antigen (collagen type I receptor, thrombospondin receptor)-like 2 (lysosomal integral membrane protein II) | 3.08 | 0.00091 | 10.92 | 8.89 | 10.63 | 71.35 | 58.02 | 37.28 |
| W58520 | 3549 | nucleoporin 88kD | #N/A | #N/A | 24.77 | 26.75 | 16.56 | 81.88 | 87.47 | 37.77 |
| W81053 | 3607 | EST | 4.91 | 0.00164 | −21.38 | −13.04 | 24.17 | 135.84 | 109.34 | 113.36 |
| X02160 | 3668 | insulin receptor | 5.29 | 0.0001 | 10.06 | 8.21 | 10.89 | 77.32 | 65.71 | 45.53 |
| X07618 | 3688 | cytochrome P450, subfamily IID (debrisoquine, sparteine, etc., -metabolising), polypeptide 7a (pseudogene) | 35.79 | 0.00065 | 59.61 | 12.32 | 101.97 | 1429.98 | 1631.04 | 671.55 |
| X07618 | 3688 | cytochrome P450, subfamily IID (debrisoquine, sparteine, etc., -metabolising), polypeptide 7a (pseudogene) | 35.79 | 0.00065 | 40.81 | 38.21 | 14.35 | 609.22 | 605.91 | 330.02 |
| X14787 | 3701 | thrombospondin 1 | 3.69 | 0.01115 | 21.81 | 22.87 | 7.7 | 143.24 | 86.81 | 166.32 |
| X16260 | 3707 | inter-alpha (globulin) inhibitor, H1 polypeptide | 44.65 | 0.00933 | 40.4 | 36.54 | 67 | 1261.99 | 1133 | 523.31 |
| X60673 | 3749 | adenylate kinase 3 | 8.3 | 0.00016 | 23.02 | 32.17 | 44.24 | 331.58 | 324.75 | 164.03 |
| X92475 | 3821 | ITBA1 gene | #N/A | #N/A | 56.74 | 63.84 | 25.6 | 66.2 | 63.72 | 20.36 |
| Y00317 | 3842 | UDP glycosyltransferase 2 family, polypeptide B4 | 18.34 | 0.00001 | −9.82 | −11.91 | 20.96 | 456.09 | 477.28 | 257.07 |
| Y00317 | 3842 | UDP glycosyltransferase 2 family, polypeptide B4 | 18.34 | 0.00001 | 11.31 | 14.85 | 7.33 | 231.32 | 282.35 | 122.76 |
| Y10659 | 3856 | interleukin 13 receptor, alpha 1 | 4.22 | 0.00061 | 18.27 | 12.85 | 25.15 | 123.23 | 134.47 | 49.24 |
| Y10659 | 3856 | interleukin 13 receptor, alpha 1 | 4.22 | 0.00061 | 15.82 | 16.3 | 16.79 | 81.75 | 89.09 | 37.01 |
| Y12711 | 3858 | progesterone binding protein | 14.83 | 0.00285 | 26.37 | 16.12 | 99.79 | 1061.83 | 935.43 | 829.85 |
| Z29481 | 3874 | 3-hydroxyanthranilate 3,4-dioxygenase | 6.39 | 0.00029 | 546.48 | 440.33 | 293.12 | 2012.12 | 1797.38 | 944.18 |
| Z30425 | 3875 | nuclear receptor subfamily 1, group I, member 3 | 26.64 | 0 | 5.66 | 7.49 | 8.02 | 181.6 | 192.48 | 76.65 |
| Z48475 | 3940 | glucokinase (hexokinase 4) regulatory protein | 13.84 | 0 | −42.61 | −53.52 | 23.46 | 305.23 | 239.52 | 155.98 |
| AA004707 | 10 | copper chaperone for superoxide dismutase | #N/A | #N/A | 217.76 | 217.72 | 144.41 | 502.14 | 479.38 | 161.01 |
| AA005202 | 12 | retinol-binding protein 4, interstitial | 3.18 | 0.00106 | 43.46 | 41.24 | 9.66 | 163.36 | 107.5 | 110.2 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA010619 | 27 | EST | 8.55 | 0.00057 | 21.58 | 5.47 | 42.99 | 279.66 | 268.6 | 154.98 |
| AA017146 | 36 | EST | 10.1 | 0.00052 | 30.35 | 22.85 | 50.05 | 414.24 | 435.09 | 193.39 |
| AA019715 | 41 | EST | #N/A | #N/A | 8.03 | 8.03 | 6.49 | 15.9 | 14.58 | 7.82 |
| AA024866 | 49 | EST | #N/A | #N/A | 10.89 | 7.87 | 8.56 | 31.16 | 30.56 | 14.26 |
| AA025930 | 52 | EST | 3.59 | 0.00372 | 33.24 | 25.62 | 26.11 | 115.2 | 110.13 | 45.17 |
| AA032250 | 73 | EST | 3.56 | 0.0009 | 10.56 | 13.86 | 9.55 | 84.44 | 83.69 | 50.06 |
| AA043790 | 99 | KIAA0937 protein | #N/A | #N/A | 5.63 | 7.44 | 12.94 | 32.16 | 31.34 | 10.66 |
| AA045481 | 107 | EST | #N/A | #N/A | 28.81 | 21.88 | 17.14 | 71.32 | 63.94 | 38.49 |
| AA046747 | 114 | EST | 4.82 | 0.00022 | -5.19 | -4.2 | 10.73 | 113.78 | 88.54 | 66.41 |
| AA053917 | 131 | EST | #N/A | #N/A | -18.24 | -11.6 | 21.61 | 56.08 | 38.68 | 82.71 |
| AA055992 | 136 | calumenin | 3.51 | 0.00604 | 80.45 | 65.8 | 47.34 | 276.06 | 265.13 | 141.34 |
| AA056735 | 142 | SEC24 (S. cerevisiae) related gene family, member D | #N/A | #N/A | 4.59 | 10.03 | 14.42 | 29.84 | 28.43 | 10.97 |
| AA076672 | 172 | EST | #N/A | #N/A | 86.18 | 87.53 | 60.88 | 122.82 | 105.84 | 54.8 |
| AA084286 | 176 | paternally expressed gene 3 | #N/A | #N/A | -2.06 | 0.32 | 14.88 | 30.7 | 26.84 | 20.69 |
| AA084318 | 177 | EST | #N/A | #N/A | 9.73 | 3.97 | 17.06 | 30.63 | 32.37 | 11.48 |
| AA098864 | 205 | EST | #N/A | #N/A | 30.42 | 31.06 | 18.38 | 56.43 | 52.57 | 21.3 |
| AA102098 | 218 | EST | #N/A | #N/A | -1.8 | -5.18 | 15.21 | 21.79 | 20.01 | 6.78 |
| AA102571 | 220 | EST | #N/A | #N/A | 8.7 | 12.32 | 15.12 | 17.15 | 15.33 | 7.6 |
| AA116075 | 234 | EST | #N/A | #N/A | 29.71 | 23.88 | 10 | 62.94 | 64.79 | 25.13 |
| AA121140 | 235 | EST | 3.33 | 0.00058 | 6.67 | 5.82 | 3.73 | 74.84 | 83.56 | 31.9 |
| AA121257 | 236 | EST | #N/A | #N/A | 21.76 | 21.21 | 32.49 | 42.39 | 43.62 | 11.55 |
| AA128177 | 258 | sequence-specific single-stranded-DNA-binding protein | #N/A | #N/A | 11.71 | 6.05 | 16.96 | 44.4 | 33.57 | 33.54 |
| AA133215 | 277 | calcitonin receptor-like receptor activity modifying protein 1 | 4.55 | 0.02092 | 76.1 | 37.86 | 72.97 | 250.94 | 266.82 | 64.2 |
| AA136611 | 303 | EST | #N/A | #N/A | 9.05 | 6.82 | 8.39 | 48.23 | 42.67 | 13.53 |
| AA136940 | 305 | EST | #N/A | #N/A | 40.81 | 41.78 | 20.7 | 79.13 | 73.37 | 41.89 |
| AA147626 | 316 | EST | #N/A | #N/A | 37.93 | 20.43 | 44.09 | 82.38 | 75.98 | 37.45 |
| AA147646 | 317 | DKFZP586A0522 protein | 21.82 | 0 | 15.59 | 14.85 | 24.51 | 610.52 | 685.45 | 288.9 |
| AA148480 | 318 | flavin containing monooxygenase 5 | 19.64 | 0 | 18.26 | 14.26 | 14.85 | 521.95 | 407.11 | 247.99 |
| AA148539 | 319 | EST | #N/A | #N/A | 9.96 | 9.87 | 8.65 | 28.88 | 25.89 | 6.73 |
| AA150205 | 328 | EST | #N/A | #N/A | -1.1 | -1.72 | 9.15 | 8.12 | 7.44 | 9.59 |
| AA150284 | 329 | EST | #N/A | #N/A | 28.51 | 25.35 | 17.97 | 41.67 | 43.94 | 18.29 |
| AA151243 | 334 | EST | #N/A | #N/A | 1.13 | -0.17 | 14.55 | 43.61 | 42.74 | 11.08 |
| AA182030 | 387 | EST | 8.32 | 0.00018 | 14.05 | 16.82 | 12.13 | 222.23 | 220.01 | 117.56 |
| AA182568 | 388 | STAT induced STAT inhibitor-2 | 10.92 | 0.00099 | 23.5 | 18.15 | 21.15 | 501.87 | 386.2 | 478.02 |
| AA187437 | 389 | EST | #N/A | #N/A | 33.59 | 47.3 | 26.91 | 62.23 | 63 | 25.01 |
| AA193671 | 405 | KIAA0580 protein | #N/A | #N/A | 40.18 | 43.2 | 23.51 | 64.83 | 38.29 | 71.28 |
| AA195657 | 419 | EST | #N/A | #N/A | 5.72 | 7.44 | 9.74 | 157.7 | 136.21 | 100.68 |
| AA211370 | 432 | EST | 6.44 | 0.00016 | 27.26 | 29.44 | 16.5 | 44.85 | 45.87 | 21.25 |
| AA227968 | 461 | histone deacetylase 6 | #N/A | #N/A | 177.49 | 137.57 | 94.86 | 349.29 | 340.4 | 101.81 |
| AA233126 | 466 | EST | #N/A | #N/A | 48.86 | 59.64 | 33.59 | 88.56 | 74.17 | 35.35 |
| AA233369 | 471 | histidine ammonia-lyase | 9.06 | 0.0008 | 49.39 | 47.92 | 39.8 | 425.35 | 405.81 | 214.85 |
| AA233763 | 472 | EST | 4.61 | 0.00004 | 25.29 | 36.26 | 17.49 | 146.52 | 139.66 | 60.53 |
| AA234717 | 489 | EST | #N/A | #N/A | 10.99 | 5.01 | 20.04 | 50.22 | 53.32 | 31.32 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA234831 | 491 | EST | 3.42 | 0.00206 | 23.54 | 21.62 | 28.81 | 112.19 | 119 | 49.23 |
| AA242822 | 524 | EST | #N/A | #N/A | 9.44 | 13.66 | 8.25 | 27.21 | 25.96 | 16.64 |
| AA243654 | 532 | EST | #N/A | #N/A | 0.67 | 3.93 | 11.08 | 69.19 | 62.85 | 48.63 |
| AA251114 | 539 | prostate cancer overexpressed gene 1 | 6.6 | 0.00039 | 28.47 | 18.55 | 28.89 | 219.81 | 202.99 | 87.55 |
| AA251776 | 545 | jun D proto-oncogene | #N/A | #N/A | 30.8 | 23.59 | 32.23 | 51.25 | 46.83 | 15.96 |
| AA251845 | 548 | EST | #N/A | #N/A | 269.35 | 283.55 | 60.62 | 477.47 | 411.47 | 377.99 |
| AA253410 | 564 | EST | #N/A | #N/A | 18.46 | 7.23 | 42.79 | 49.37 | 26.82 | 45.2 |
| AA255546 | 569 | EST | 4 | 0.00301 | 61.04 | 67.88 | 31.64 | 260.34 | 224.12 | 142.84 |
| AA256990 | 585 | EST | #N/A | #N/A | 8.43 | 11.36 | 27.79 | 15.63 | 16.56 | 6.89 |
| AA258158 | 588 | EST | 13.15 | 0.00001 | 7.91 | 2.43 | 17.94 | 44.84 | 34.32 | 35.63 |
| AA259064 | 602 | EST | #N/A | #N/A | 15.32 | -1.37 | 28.67 | 401.93 | 394.99 | 178.23 |
| AA278670 | 616 | EST | #N/A | #N/A | 7.44 | 11.47 | 12.63 | 54.24 | 49.98 | 28.69 |
| AA278824 | 619 | EST | #N/A | #N/A | 26.85 | 31.59 | 11.72 | 83.48 | 91.25 | 30.24 |
| AA278853 | 621 | EST | #N/A | #N/A | 10.28 | 11.7 | 21.49 | 42.68 | 43.68 | 17.64 |
| AA279341 | 625 | EST | #N/A | #N/A | 67.56 | 80.37 | 50.19 | 132.89 | 118.11 | 67.28 |
| AA281545 | 645 | EST | 3.64 | 0.00002 | 6.52 | -0.81 | 16.89 | 87.27 | 85.27 | 34.29 |
| AA281770 | 649 | seven in absentia (Drosophila) homolog 1 | 3.96 | 0.00094 | 7.67 | 4.72 | 15.41 | 103.75 | 79.4 | 70.74 |
| AA281796 | 650 | mannose-P-dolichol utilization defect 1 | 3.3 | 0.04108 | 65.08 | 53.58 | 57.86 | 170.88 | 165.02 | 41.87 |
| AA283066 | 666 | EST | #N/A | #N/A | 21.18 | 25.64 | 13.39 | 67.44 | 59.46 | 35.89 |
| AA284795 | 678 | phosphatidylethanolamine N-methyltransferase | 10.03 | 0.00019 | 44.8 | 62.07 | 44.12 | 514.93 | 591.52 | 206.4 |
| AA286710 | 683 | lymphocyte adaptor protein | #N/A | #N/A | 37.88 | 39.15 | 30.32 | 82.93 | 86.15 | 45.58 |
| AA287566 | 690 | KIAA0187 gene product | 9.07 | 0.00013 | 4.86 | 6.24 | 7.4 | 246.24 | 201.66 | 228.64 |
| AA291293 | 698 | EST | #N/A | #N/A | 17.35 | 18.07 | 17.24 | 33.6 | 33.3 | 5.56 |
| AA342918 | 750 | EST | #N/A | #N/A | 23.67 | 31.68 | 25.77 | 69.4 | 73.71 | 18.13 |
| AA365691 | 763 | EST | #N/A | #N/A | 48.01 | 47.17 | 25.37 | 28.69 | 26.73 | 13.89 |
| AA397904 | 781 | EST | #N/A | #N/A | 22.74 | 18.55 | 19.05 | 59.75 | 54.83 | 32.24 |
| AA398124 | 787 | growth factor receptor-bound protein 14 | 7.82 | 0.00009 | 3.4 | 5.86 | 7.61 | 189.27 | 167.23 | 110.44 |
| AA393386 | 793 | EST | 5.71 | 0.00007 | 10.59 | 16.25 | 21.59 | 153.16 | 164.38 | 83.94 |
| AA398423 | 795 | EST | 8.26 | 0.00063 | -17.3 | -16.19 | 23.92 | 230.91 | 250.5 | 156.29 |
| AA398674 | 798 | thrombospondin 1 | #N/A | #N/A | -27.87 | 14.49 | 146.65 | 137.87 | 96.14 | 119.21 |
| AA400979 | 825 | calcitonin receptor-like receptor activity modifying protein 3 | 6.65 | 0.01051 | 48.89 | 21.04 | 80.4 | 276.38 | 267.3 | 88.7 |
| AA401091 | 826 | EST | #N/A | #N/A | 31.88 | 32.59 | 43.51 | 30.55 | 19.82 | 28.68 |
| AA402224 | 836 | growth arrest and DNA-damage-inducible, gamma | 14.41 | 0.00012 | 37.55 | 48.88 | 48.58 | 749.36 | 812.2 | 443.66 |
| AA402610 | 839 | EST | #N/A | #N/A | 3.02 | 6.69 | 13.83 | 27.54 | 23.2 | 17.78 |
| AA402656 | 841 | KIAA0548 protein | 12.05 | 0.00001 | -2.56 | 18.8 | 40.57 | 342.11 | 315.47 | 205.61 |
| AA404248 | 847 | EST | #N/A | #N/A | 11.96 | 11.18 | 10.84 | 40.92 | 35.06 | 17.49 |
| AA405495 | 859 | EST | #N/A | #N/A | 26.12 | 22.63 | 43.42 | 79 | 82.8 | 30.16 |
| AA405744 | 863 | EST | #N/A | #N/A | 61.18 | 28.74 | 58.71 | 64.39 | 57.95 | 35.67 |
| AA406363 | 874 | EST | #N/A | #N/A | 6.85 | 5.69 | 15.69 | 35.62 | 35.06 | 13.69 |
| AA406610 | 880 | EST | #N/A | #N/A | 5.99 | 6.04 | 4.63 | 35.94 | 34.84 | 11.57 |
| AA410255 | 882 | EST | 7.56 | 0.00043 | 0.82 | 4.15 | 11.49 | 195.75 | 236.93 | 110.49 |
| AA411795 | 892 | EST | #N/A | #N/A | 72.18 | 53.17 | 44.28 | 130.27 | 131.65 | 23.71 |
| AA412063 | 895 | EST | 8.26 | 0.00001 | 11.36 | 14.03 | 19.55 | 220.12 | 187.85 | 149.43 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA412149 | 897 | KIAA0480 gene product | #N/A | #N/A | 14.07 | 10.08 | 14.16 | 37.43 | 32.4 | 15.56 |
| AA412520 | 903 | EST | #N/A | #N/A | 18.84 | 14.4 | 14.11 | 80.29 | 103.19 | 41.98 |
| AA412700 | 904 | ubiquitin-conjugating enzyme E2L 6 | #N/A | #N/A | 139.65 | 95.44 | 135.61 | 275.39 | 273.98 | 112.87 |
| AA418398 | 921 | EST | #N/A | #N/A | 0.1 | −6.02 | 17.92 | 30.41 | 32 | 20.72 |
| AA421051 | 928 | serum-inducible kinase | #N/A | #N/A | 42.94 | 7.14 | 87.89 | 51.27 | 45.65 | 28 |
| AA421052 | 929 | branched chain alpha-ketoacid dehydrogenase kinase | 3.52 | 0.00869 | 77.76 | 94.75 | 43.63 | 251.45 | 221.35 | 109.93 |
| AA425214 | 950 | EST | #N/A | #N/A | 2.71 | 2.07 | 4.88 | 21.4 | 20.31 | 10.15 |
| AA426643 | 970 | EST | #N/A | #N/A | 9.96 | 0.97 | 18.11 | 48.26 | 47.37 | 23.47 |
| AA427537 | 974 | DKFZP566I153 protein | #N/A | #N/A | 183.26 | 156.56 | 68.58 | 259.57 | 242.97 | 79.81 |
| AA427579 | 975 | regulator of G-protein signalling 14 | #N/A | #N/A | 13.35 | 13.28 | 16.49 | 34.79 | 25.25 | 25.11 |
| AA427819 | 980 | midline 2 | 3.44 | 0.00063 | 25.98 | 17.06 | 14.91 | 97.03 | 93.49 | 31.39 |
| AA428150 | 985 | EST | 5.24 | 0.00167 | 41.92 | 35.06 | 30.53 | 213.96 | 217.27 | 76.08 |
| AA428325 | 988 | EST | 8.36 | 0.00002 | −0.52 | 3.28 | 16.92 | 194.02 | 167.37 | 111.11 |
| AA429478 | 998 | EST | 3.41 | 0.02599 | 55.86 | 65.19 | 47.48 | 192.7 | 196 | 89.2 |
| AA435591 | 1038 | kinesin family member 3B | 3.5 | 0.0001 | 3.57 | 3.68 | 10.34 | 75.9 | 81.12 | 29.32 |
| AA436156 | 1051 | EST | #N/A | #N/A | 22.66 | 7.78 | 34.68 | 54.98 | 48.35 | 38.09 |
| AA436548 | 1054 | EST | #N/A | #N/A | 5.08 | 5.93 | 5.2 | 40.27 | 38.99 | 22.22 |
| AA436880 | 1058 | EST | 3.22 | 0.00699 | 4.71 | 9.21 | 13.85 | 86.89 | 68.41 | 66.5 |
| AA437295 | 1062 | ribosomal protein L7a | 4.35 | 0.00347 | 19.67 | 20.38 | 43.07 | 139.16 | 140.38 | 70.9 |
| AA443658 | 1079 | transmembrane 7 superfamily member 2 | 9.06 | 0.00048 | 4.48 | 17.91 | 24.51 | 276.02 | 194.73 | 227.48 |
| AA447802 | 1108 | EST | #N/A | #N/A | 15.64 | 17.7 | 13.81 | 21.51 | 21.34 | 7.37 |
| AA449108 | 1118 | EST | #N/A | #N/A | 10.9 | 18.13 | 15.28 | 52.58 | 57.3 | 23.76 |
| AA449297 | 1121 | EST | 3.78 | 0.00039 | 3.76 | 0.63 | 19.01 | 91.67 | 81.15 | 55.17 |
| AA454667 | 1167 | EST | #N/A | #N/A | 21.25 | 12.77 | 23.4 | 83.02 | 75.81 | 56.63 |
| AA455111 | 1173 | heterogeneous nuclear ribonucleoprotein C (C1/C2) | #N/A | #N/A | −31.71 | −40.39 | 38.45 | 38.96 | 36.83 | 26.21 |
| AA455261 | 1175 | chromobox homolog 7 | #N/A | #N/A | 32.5 | 45.54 | 26.51 | 66.78 | 66.08 | 30.15 |
| AA455865 | 1180 | phosphatidylinositol glycan, class B | 5.41 | 0.00004 | 11.68 | 8.67 | 10.65 | 133.15 | 134.74 | 63.3 |
| AA455987 | 1183 | EST | 5.36 | 0.00029 | 20.54 | 17.51 | 15.24 | 128.55 | 130.64 | 17.07 |
| AA455988 | 1184 | butyrobetaine (gamma), 2-oxoglutarate dioxygenase (gamma-butyrobetaine hydroxylase) | 15.54 | 0.00001 | 10.13 | 11.88 | 8.38 | 354.42 | 375.91 | 141.08 |
| AA456075 | 1186 | RAD23 (S. cerevisiae) homolog A | #N/A | #N/A | 33.34 | 38.35 | 32.93 | 90.47 | 66.92 | 66.03 |
| AA456080 | 1187 | EST | #N/A | #N/A | 32.35 | 17.59 | 33.21 | 27.76 | 26.18 | 12.38 |
| AA456147 | 1188 | general transcription factor IIIA | 4.23 | 0.00088 | 4.61 | 0.17 | 9.08 | 102.1 | 89.95 | 63.84 |
| AA456289 | 1189 | EST | 15.31 | 0.00004 | 18.07 | 17.84 | 39.22 | 512.64 | 542.52 | 303.15 |
| AA456612 | 1195 | EST | #N/A | #N/A | 164.11 | 136.36 | 117.01 | 254.26 | 266.45 | 84.11 |
| AA458652 | 1202 | EST | 8.26 | 0.00001 | 19.3 | 18.21 | 17.18 | 203.23 | 218.67 | 53.52 |
| AA459005 | 1210 | EST | #N/A | #N/A | −3.57 | 12.22 | 40.05 | 49.76 | 42.58 | 28.85 |
| AA461448 | 1240 | EST | #N/A | #N/A | 1.74 | −4.19 | 22.52 | 58.65 | 56.06 | 32.42 |
| AA464606 | 1261 | MRS1 protein | #N/A | #N/A | 24.35 | 19.03 | 39.62 | 59.55 | 36.75 | 57.76 |
| AA465720 | 1274 | EST | #N/A | #N/A | 11.5 | 21.33 | 37.22 | 93.06 | 108.97 | 43.26 |
| AA470153 | 1275 | solute carrier family 21 (organic anion transporter), member 9 | 13.26 | 0.00315 | 47.49 | 48.57 | 116.54 | 726.75 | 713.23 | 297.62 |
| | | homolog of mouse quaking QKI (KH domain | | | | | | | | |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA478104 | 1296 | RNA binding protein) | #N/A | #N/A | −7.07 | −11.44 | 23.2 | 62.06 | 47.17 | 56.07 |
| AA478441 | 1302 | cathepsin F | 5.07 | 0.00752 | 53.85 | 67.48 | 43.52 | 243.44 | 243.61 | 69.17 |
| AA479148 | 1311 | EST | 38.05 | 0 | 6.2 | 1.32 | 14.38 | 895.91 | 847.72 | 362.53 |
| AA479488 | 1313 | S-adenosylhomocysteine hydrolase-like 1 | 4 | 0.0269 | 75.18 | 60.93 | 59.8 | 241.1 | 222.96 | 112.87 |
| AA480091 | 1323 | EST | 8.59 | 0.00156 | 48.08 | 25.74 | 51.03 | 444.29 | 309.38 | 367.89 |
| AA487195 | 1354 | EST | #N/A | #N/A | 8.73 | 7.94 | 9.21 | 21.04 | 14.67 | 16.52 |
| AA487576 | 1357 | EST | #N/A | #N/A | −12.17 | −14.87 | 17.17 | 26.05 | 25.27 | 11.13 |
| AA489009 | 1366 | EST | #N/A | #N/A | 15.19 | 18.01 | 8.67 | 59.19 | 45.15 | 41.42 |
| AA490964 | 1384 | EST | #N/A | #N/A | 20.3 | 17.53 | 11.39 | 47.7 | 41.84 | 25.18 |
| AA495803 | 1392 | EST | #N/A | #N/A | 95.29 | 83.46 | 90.72 | 94.07 | 93.85 | 37.65 |
| AA495924 | 1395 | kinesin family member 3B | #N/A | #N/A | 4.16 | 3.28 | 2.95 | 35.69 | 34.43 | 19.93 |
| AA496053 | 1396 | EST | 3.28 | 0.00095 | 5.36 | 2.22 | 17.58 | 81.79 | 94.01 | 42.77 |
| AA496936 | 1403 | EST | #N/A | #N/A | 17.71 | 9.86 | 20.19 | 30.24 | 34.4 | 14.77 |
| AA504324 | 1412 | EST | #N/A | #N/A | 45.99 | 38.81 | 31.27 | 74.31 | 72.05 | 31.59 |
| AA521290 | 1421 | EST | 4.53 | 0.0148 | 46.54 | 22.84 | 63.63 | 166.84 | 174.65 | 58.28 |
| AA598412 | 1425 | EST | #N/A | #N/A | −2.4 | −5.93 | 29.83 | 59 | 52.53 | 29.41 |
| AA598453 | 1429 | EST | #N/A | #N/A | 7.27 | 7.06 | 9.67 | 67.15 | 54.25 | 41.65 |
| AA599107 | 1443 | EST | #N/A | #N/A | 53.34 | 10 | 88.85 | 77.28 | 58.08 | 40.75 |
| AA599214 | 1446 | EST | #N/A | #N/A | 10.94 | 7.36 | 12.27 | 34.58 | 36 | 14.54 |
| AA608546 | 1463 | EST | 12.52 | 0.00003 | −19.59 | −29.07 | 29.39 | 310.07 | 300.44 | 189.6 |
| AA608723 | 1467 | EST | #N/A | #N/A | 17.44 | 15.29 | 13.31 | 66.54 | 70.38 | 20.94 |
| AA609316 | 1481 | EGF-like-domain, multiple 5 | 7.97 | 0.00011 | 22.6 | 21.61 | 25.56 | 236.54 | 226.79 | 65.9 |
| AA609519 | 1482 | EST | 8.13 | 0.00009 | 29.3 | 22.08 | 22.59 | 261.82 | 243.76 | 105.33 |
| AA620965 | 1511 | NOT3 (negative regulator of transcription 3, yeast) homolog similar to Caenorhabditis elegans protein C42C1.9 | #N/A | #N/A | 4.34 | 8.96 | 16.51 | 48.05 | 40.77 | 32.06 |
| AA621209 | 1516 | EST | 6.34 | 0.00144 | 22.77 | 19.95 | 46.78 | 214.61 | 167.05 | 138.24 |
| AA621235 | 1517 | EST | 3.44 | 0.0021 | 26.29 | 24.68 | 23.17 | 114.75 | 113.36 | 65.35 |
| D56989 | 1687 | EST | #N/A | #N/A | 8.83 | 6.61 | 9.79 | 77.62 | 55.56 | 72.14 |
| D59294 | 1693 | EST | #N/A | #N/A | 1.31 | 0.89 | 6.58 | 22.83 | 20.84 | 14.1 |
| F04611 | 1792 | EST | 23.96 | 0.00018 | 42.65 | 18.88 | 62.74 | 1011.12 | 1040.46 | 589.37 |
| F04677 | 1794 | EST | #N/A | #N/A | 138.06 | 123.28 | 34.39 | 355.75 | 310.97 | 168.21 |
| F09350 | 1801 | EST | 4.79 | 0.00088 | 13.91 | −6.46 | 33.97 | 147.64 | 130.28 | 79.24 |
| F09687 | 1806 | EST | #N/A | #N/A | 12.72 | 8.26 | 28.12 | 58.85 | 57.03 | 31.82 |
| F09729 | 1807 | EST | #N/A | #N/A | 9.35 | 20.58 | 23.17 | 55.49 | 55.78 | 27.37 |
| F09979 | 1809 | EST | 4.36 | 0.02555 | 6.98 | 6.51 | 20.72 | 226.47 | 116.41 | 288.21 |
| F10149 | 1810 | EST | #N/A | #N/A | 111.86 | 108.46 | 60.06 | 257.05 | 276.87 | 165.09 |
| F10381 | 1817 | KIAA0541 protein | #N/A | #N/A | 22.16 | 25.03 | 8.75 | 64.94 | 71.82 | 26.24 |
| F10418 | 1818 | EST | #N/A | #N/A | 44.91 | 44.45 | 22.72 | 64.3 | 52.54 | 31.96 |
| F13624 | 1825 | breast cancer anti-estrogen resistance 3 | #N/A | #N/A | 27.76 | 19.2 | 32.49 | 90.8 | 73.79 | 59.27 |
| F13782 | 1827 | LIM binding domain 2 | 4.17 | 0.00109 | −0.64 | 5.61 | 22.4 | 100.8 | 119.01 | 55.07 |
| H01059 | 1830 | solute carrier family 16 (monocarboxylic acid transporters), member 4 | #N/A | #N/A | 9.13 | 9.22 | 13.53 | 32.73 | 34.27 | 21.05 |
| H02855 | 1832 | EST | 5.96 | 0.00458 | 5.06 | 1.15 | 14.13 | 261.57 | 93.25 | 407.93 |
| H05970 | 1849 | EST | #N/A | #N/A | 9.16 | 12.81 | 14.19 | 68.16 | 65.08 | 40.19 |
| H09331 | 1865 | EST | #N/A | #N/A | 313.2 | 309.79 | 122.67 | 512.04 | 486.42 | 149.27 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| H09353 | 1866 | EST | 23.06 | 0.00094 | 45.11 | 18.95 | 65.29 | 782.6 | 824.74 | 226.28 |
| H10661 | 1871 | EST | 4.54 | 0.00276 | 31.29 | 18.75 | 28.5 | 132.09 | 124.86 | 64.37 |
| H12593 | 1880 | zinc-finger protein 265 | 10.72 | 0.0056 | 39.96 | −9.15 | 111.74 | 515.58 | 506.07 | 224.5 |
| H19504 | 1895 | EST | 3.13 | 0.04948 | 77.07 | 49.48 | 64.05 | 227.6 | 221.91 | 125.23 |
| H20543 | 1897 | DKFZP586B1621 protein | 31.03 | 0.00074 | 62.11 | 36.98 | 80.24 | 1684.92 | 1680.81 | 731.79 |
| H24081 | 1901 | KIAA1035 protein | #N/A | #N/A | 19.72 | 18.46 | 5.69 | 24.15 | 27.08 | 9.52 |
| H25124 | 1903 | EST | 3.65 | 0.00004 | 20.47 | 14.4 | 12.59 | 95.09 | 85.36 | 34.91 |
| H29568 | 1914 | EST | 11.45 | 0.00058 | 232.54 | 140.09 | 218.85 | 2206.49 | 1884.76 | 783.84 |
| H30270 | 1915 | EST | 17.09 | 0.00001 | 61.64 | 60.29 | 25.01 | 1224.59 | 1332.66 | 695.76 |
| H49417 | 1939 | ATP-binding cassette, sub-family C (CFTR/MRP), member 6 | #N/A | #N/A | 16.93 | 17.31 | 8.56 | 62.68 | 54.75 | 48.37 |
| H52251 | 1942 | EST | #N/A | #N/A | 25.41 | 22.3 | 15.29 | 33.86 | 34.48 | 19.95 |
| H53829 | 1946 | EST | #N/A | #N/A | 44.31 | 40.52 | 36.62 | 99.9 | 98.22 | 46.1 |
| H56965 | 1952 | EST | #N/A | #N/A | 0.18 | 0.68 | 12.9 | 61.03 | 73.89 | 30.12 |
| H57850 | 1958 | protein phosphatase 2 (formerly 2A), regulatory subunit A (PR 65), beta isoform | 3.02 | 0.00123 | 41.36 | 36.05 | 15.14 | 131.12 | 130.36 | 53.67 |
| H58692 | 1960 | formyltetrahydrofolate dehydrogenase | 81.41 | 0 | −2.66 | 5.46 | 16.1 | 1886.69 | 1520.43 | 1129.35 |
| H60317 | 1965 | EST | #N/A | #N/A | 18.86 | 22.34 | 11.81 | 38.92 | 39.1 | 18.67 |
| H69565 | 1987 | EST | 4.11 | 0.00002 | 15.45 | 16.92 | 9.4 | 95.6 | 94.91 | 42.92 |
| H70485 | 1988 | EST | #N/A | #N/A | 113.44 | 81.62 | 63.73 | 232.9 | 256.86 | 107.1 |
| H70554 | 1989 | EST | 10.99 | 0 | −11.73 | −19.98 | 33.09 | 292.66 | 288.78 | 153.17 |
| H87765 | 2017 | KIAA0626 gene product | 3.86 | 0.00131 | 5.2 | 7.91 | 19.6 | 94.26 | 93.78 | 60.64 |
| H89980 | 2026 | protein phosphatase 1, regulatory (inhibitor) subunit 5 | 31.13 | 0.00006 | 12.16 | 13.82 | 12.3 | 990.48 | 1005.21 | 755.6 |
| H90417 | 2028 | EST | 4.17 | 0.015 | 14.23 | −10.79 | 70.02 | 191.04 | 154.37 | 125.5 |
| H93381 | 2036 | EST | 24.23 | 0 | 6.08 | −0.69 | 28.81 | 621.48 | 640.77 | 214.25 |
| H95079 | 2046 | EST | #N/A | #N/A | 7.05 | 11.03 | 7.33 | 39.79 | 33.3 | 29.08 |
| H95089 | 2047 | EST | #N/A | #N/A | 13.05 | 13.54 | 4.03 | 31.99 | 31.89 | 13.19 |
| H95358 | 2049 | EST | 3.17 | 0.00182 | −5.85 | −5.95 | 11.57 | 74.74 | 72.66 | 42.36 |
| H95978 | 2052 | EST | 8.55 | 0.00046 | 12.28 | 14.38 | 10.71 | 240.91 | 246.43 | 147.67 |
| H98083 | 2067 | EST | 5.09 | 0.00025 | 11.73 | 11.11 | 3.97 | 121.51 | 104.88 | 70.52 |
| N22404 | 2449 | EST | 3.99 | 0.01152 | 30.59 | 23.97 | 55.32 | 193.63 | 130.09 | 162.83 |
| N22434 | 2450 | EST | 4.37 | 0.01725 | 100.96 | 66.55 | 110.62 | 334.51 | 328.98 | 150.7 |
| N24879 | 2459 | EST | 9.44 | 0.00008 | 6.2 | 5.49 | 23.52 | 280.93 | 337.77 | 165.77 |
| N24973 | 2461 | EST | #N/A | #N/A | 30.46 | 28.45 | 11.29 | 56.57 | 59.09 | 22.87 |
| N25262 | 2464 | EST | #N/A | #N/A | 31.16 | 28.04 | 9.03 | 64.13 | 64.97 | 18.29 |
| N27524 | 2471 | EST | 3.13 | 0.00216 | 14.18 | 22.08 | 20.51 | 87.67 | 98.26 | 42.62 |
| N29353 | 2476 | kynurenine 3-monooxygenase (kynurenine 3-hydroxylase) | 4.78 | 0.00019 | −4.7 | −5.88 | 13.94 | 109.79 | 101.27 | 53.38 |
| N29543 | 2478 | EST | #N/A | #N/A | 11.66 | 9.07 | 5.04 | 59.21 | 51.22 | 30.43 |
| N29740 | 2479 | EST | #N/A | #N/A | 48.71 | 27.45 | 46.9 | 80.01 | 77.9 | 37.18 |
| N31952 | 2489 | EST | 3.13 | 0.01481 | 36.21 | 27.5 | 25.04 | 133.49 | 147.66 | 83.03 |
| N34804 | 2496 | DKFZP434f214 protein | 8.08 | 0.00028 | 6.99 | 5.94 | 33.73 | 344.08 | 176.4 | 532.11 |
| N34919 | 2498 | EST | 7.39 | 0 | 8 | 6.82 | 52.96 | 44.23 | 24.23 | |
| N36085 | 2504 | EST | 20.98 | #N/A | 19.21 | 13.89 | 58.28 | 58 | 22.95 | |
| N45320 | 2518 | EST | 11.39 | #N/A | 11.26 | 7.06 | 50.75 | 36 | 39.19 | |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| N45998 | 2519 | EST | 3.14 | 0.00337 | 28.42 | 22.62 | 13.52 | 99.42 | 110.53 | 49.55 |
| N48315 | 2526 | adaptor-related protein complex 2, mu 1 subunit | 5.3 | 0.0149 | 62.03 | 30.66 | 52.29 | 368.37 | 331.28 | 260.93 |
| N48674 | 2529 | EST | 4.06 | 0.00028 | 2.7 | 4.57 | 10.52 | 94.61 | 72.82 | 54.62 |
| N50038 | 2540 | EST | #N/A | #N/A | 0.25 | 5.19 | 45.95 | 47.04 | 41.45 | 16.56 |
| N54053 | 2560 | secreted phosphoprotein 2, 24kD | 60.39 | 0.00087 | 44.3 | -18.16 | 166.47 | 2749.73 | 2790.77 | 1230.33 |
| N54604 | 2569 | EST | 3.72 | 0.00741 | 2.36 | 2.08 | 35.23 | 133.06 | 119.1 | 109.95 |
| N54792 | 2570 | cytidine monophosphate-N-acetylneuraminic acid hydroxylase (CMP-N-acetylneuraminate monooxygenase) | 3.23 | 0.00099 | 28.36 | 27.42 | 6.39 | 110.19 | 77.69 | 87.32 |
| N59089 | 2580 | EST | 4.74 | 0.00055 | 38.4 | 36.58 | 24.6 | 215.54 | 167.6 | 133.64 |
| N59543 | 2586 | PDZ domain containing 1 | 9.96 | 0.00052 | 1.2 | -2.89 | 17.29 | 303.49 | 259.23 | 225.96 |
| N62922 | 2595 | EST | #N/A | #N/A | 14.92 | 14.15 | 2.75 | 54.94 | 52.4 | 18.93 |
| N63047 | 2596 | EST | #N/A | #N/A | 4.13 | 0.93 | 9.72 | 14.78 | 15.63 | 8.24 |
| N63698 | 2603 | EST | 7.92 | 0.00001 | 19.14 | 18.14 | 12.14 | 221.25 | 212.4 | 122.32 |
| N64436 | 2608 | EST | 3.51 | 0.00441 | 24.46 | 20.38 | 21.08 | 119.24 | 133.44 | 70.66 |
| N65959 | 2611 | EST | 5.43 | 0.00044 | 3.51 | 3.25 | 22.24 | 142.87 | 149.26 | 79.26 |
| N66613 | 2616 | EST | #N/A | #N/A | 25.61 | 22.34 | 26.39 | 62.58 | 50.13 | 51.99 |
| N68871 | 2637 | EST | 4.3 | #N/A | 4.3 | 4.02 | 8.66 | 34.08 | 36.71 | 14.33 |
| N70305 | 2654 | EST | 4.41 | 0.00078 | -13.99 | -13.48 | 10.76 | 105.8 | 97.72 | 72.15 |
| N71542 | 2664 | kidney- and liver-specific gene | 21.05 | 0 | -14.76 | -18.28 | 14.3 | 471.65 | 486.43 | 226.63 |
| N71935 | 2666 | multiple PDZ domain protein | 16.28 | 0 | 12.84 | 19.17 | 14.1 | 410.92 | 422.1 | 218.42 |
| N73883 | 2681 | EST | 9.35 | 0 | 18.47 | 23.48 | 17.67 | 256.78 | 276.41 | 95.34 |
| N74025 | 2684 | deiodinase, iodothyronine, type I | 22.79 | 0 | -7.64 | 2.14 | 15.95 | 527.67 | 515.68 | 256.99 |
| N74422 | 2685 | EST | 30.32 | 0 | 23.57 | 28.41 | 36.93 | 1063.07 | 1094.48 | 371.26 |
| N74624 | 2687 | collectin sub-family member 10 (C-type lectin) | #N/A | #N/A | 33.8 | 34.24 | 5.13 | 71.81 | 62.09 | 43.57 |
| N75072 | 2688 | EST | 3.73 | 0.00379 | 5.14 | 6.21 | 15.5 | 104.12 | 104.99 | 81.79 |
| N76086 | 2694 | EST | #N/A | #N/A | 8.23 | 7.19 | 6.54 | 55.55 | 55.02 | 35.47 |
| N91882 | 2719 | alpha2,3-sialyltransferase | 14.52 | 0.00024 | -0.18 | 0.18 | 34.36 | 512.3 | 550.51 | 320.62 |
| N93191 | 2729 | EST | 3.25 | 0.00232 | 174.54 | 168.53 | 56.36 | 659.95 | 565.08 | 409.15 |
| N93403 | 2733 | EST | #N/A | #N/A | 4.44 | 7.63 | 11.8 | 48.84 | 38.39 | 30.93 |
| N93764 | 2736 | EST | 5.92 | 0.0109 | 113.46 | 68.13 | 96.98 | 771.74 | 792.59 | 504.88 |
| R05490 | 2760 | SEC24 (S. cerevisiae) related gene family, member B | 3.03 | 0.00317 | 5.87 | 3.49 | 12.23 | 75.28 | 78.17 | 48.59 |
| R06002 | 2762 | EST | 10.15 | 0.00003 | 10.52 | 8.26 | 20.8 | 292.89 | 264.17 | 160.28 |
| R06543 | 2768 | EST | #N/A | #N/A | 61.75 | 61.42 | 88.77 | 163.57 | 144.04 | 96.98 |
| R06746 | 2770 | EST | 15.77 | 0.00009 | 13.37 | 7.19 | 39.24 | 455.48 | 410.16 | 191.35 |
| R06860 | 2772 | EST | #N/A | #N/A | 84.61 | 75.89 | 71.35 | 104.51 | 116.59 | 44.71 |
| R08564 | 2779 | plasminogen-like | 60.18 | 0.00091 | 69.78 | 24 | 105.91 | 2485.63 | 2384.62 | 531.43 |
| R09053 | 2782 | EST | 5.9 | 0.0002 | 6.45 | 17.17 | 35.01 | 186.87 | 204.61 | 113.19 |
| R10287 | 2784 | EST | 11.2 | 0.0003 | 7.46 | 4.94 | 35.03 | 376.82 | 434.91 | 198.74 |
| R10684 | 2787 | EST | 5.51 | 0.00741 | 28.67 | 1.31 | 62.39 | 217.05 | 221.32 | 122.94 |
| R12472 | 2788 | EST | 55.18 | 0.00011 | 32.21 | 3.13 | 76.26 | 2002.79 | 1930.03 | 1097.37 |
| R12579 | 2789 | EST | 3.5 | 0.00137 | 54.49 | 37.84 | 26.65 | 198.7 | 194.59 | 92.03 |
| R33146 | 2818 | EST | 7 | 0.00043 | 3.32 | 2.1 | 10.76 | 179.67 | 195.02 | 107 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| R34362 | 2821 | KIAA0327 gene product | 5.4 | 0.04615 | 621.7 | 353.73 | 689.66 | 2107.55 | 2121.04 | 1000.75 |
| R39238 | 2835 | synaptojanin 1 | #N/A | #N/A | 16.06 | 16.03 | 9.94 | 26.8 | 23.84 | 16.46 |
| R43347 | 2848 | downregulated in renal cell carcinoma | 5.37 | 0.00103 | 36.93 | 32.68 | 30.41 | 105.66 | 100.62 | 28.62 |
| R43365 | 2849 | EST | 5.71 | 0 | 5.57 | 6.67 | 12.18 | 150.58 | 112.8 | 122.96 |
| R43910 | 2851 | EST | 36.5 | 0.00001 | 23.41 | 24.6 | 11.1 | 156.7 | 166.34 | 52.21 |
| R49602 | 2884 | EST | 5.03 | 0.00761 | 19.25 | 9.65 | 26.41 | 970.39 | 905.54 | 322.69 |
| R51831 | 2890 | EST | 12.79 | 0.00001 | 5.89 | 2.5 | 44.67 | 221.54 | 195.97 | 179.99 |
| R52822 | 2895 | EST | #N/A | #N/A | 10.78 | 0.35 | 28.51 | 380.07 | 441.17 | 180.12 |
| R53044 | 2897 | KIAA0981 protein | #N/A | #N/A | 17.84 | 25.74 | 11.45 | 48.77 | 44.34 | 18.43 |
| R53891 | 2899 | EST | #N/A | #N/A | 9.88 | 5.59 | 10.68 | 66.28 | 52.16 | 49.21 |
| R59312 | 2912 | EST | #N/A | #N/A | 34.37 | 35.83 | 22.13 | 94.44 | 91.55 | 36.35 |
| R59722 | 2915 | EST | 19.74 | 0.00016 | 18.78 | -4.94 | 51.34 | 628.69 | 642.78 | 316.88 |
| R60959 | 2918 | EST | #N/A | #N/A | 31.21 | 23.86 | 17.79 | 72.94 | 69.87 | 45.25 |
| R63734 | 2927 | fatty-acid-Coenzyme A ligase, long-chain 3 | #N/A | #N/A | 13.28 | 17.42 | 12.17 | 42.74 | 39.66 | 18.51 |
| R65593 | 2934 | kynurenine 3-monooxygenase (kynurenine 3-hydroxylase) | 21.27 | 0.00007 | 28.84 | 18.5 | 43.46 | 704.58 | 812.38 | 352.86 |
| R70319 | 2945 | EST | #N/A | #N/A | 5.34 | 2.91 | 8.92 | 29.23 | 29.18 | 10.78 |
| R70791 | 2948 | EST | #N/A | #N/A | 127.11 | 110.15 | 41.83 | 73.19 | 57.2 | 56.17 |
| R73468 | 2956 | EST | #N/A | #N/A | 9.97 | 10.43 | 9.69 | 38.29 | 44.82 | 17.14 |
| R73816 | 2960 | EST | 11.53 | 0.00259 | -26.88 | -30.68 | 10.09 | 462.31 | 374.67 | 450.91 |
| R78713 | 2967 | EST | #N/A | #N/A | 0.27 | -1.59 | 8.92 | 70.57 | 57.33 | 56.37 |
| R91060 | 2980 | EST | #N/A | #N/A | 59.14 | 37.15 | 56.04 | 85.88 | 61.99 | 68.99 |
| R93507 | 2990 | EST | #N/A | #N/A | 19.53 | 20.08 | 11 | 67.62 | 67.56 | 44.22 |
| R93714 | 2991 | fetuin B | 10.42 | 0.00043 | -60.74 | -65.14 | 57.99 | 280.62 | 301.36 | 203.86 |
| R93908 | 2993 | EST | 5.8 | 0.02699 | 66.75 | 29.54 | 129.46 | 348.58 | 301.29 | 173.81 |
| R94674 | 2995 | EST | 10.76 | 0.00008 | 0.91 | 4.15 | 14.66 | 269.49 | 288.56 | 148.06 |
| R96822 | 2999 | EST | 8.25 | 0.00008 | 16.45 | 17.01 | 30.67 | 250.81 | 257.18 | 131.85 |
| R97419 | 3003 | cytochrome P450, subfamily VIIIB (sterol 12-alpha-hydroxylase), polypeptide 1 | 65.07 | 0.0039 | 152.16 | -3.42 | 302.56 | 4114.39 | 3837.4 | 1458.43 |
| R97804 | 3007 | EST | #N/A | #N/A | 144.46 | 187.67 | 95.8 | 193.05 | 201.89 | 61.84 |
| R98413 | 3011 | EST | 9.71 | 0.00007 | 38.74 | 28.05 | 21.96 | 402.49 | 443.47 | 212.95 |
| R99014 | 3014 | EST | #N/A | #N/A | 26.99 | 17.82 | 29.49 | 49.82 | 52.35 | 18 |
| T16306 | 3067 | EST | #N/A | #N/A | 24.23 | 23.64 | 24.91 | 58.82 | 63.62 | 22.35 |
| T40895 | 3116 | protein tyrosine phosphatase type IVA, member 1 | #N/A | #N/A | 1575.59 | 2039.82 | 1098.29 | 4148.86 | 2440.28 | 4169.52 |
| T46901 | 3122 | EST | 77.28 | 0.0006 | 11.33 | -31.1 | 121.66 | 2608.54 | 2853.98 | 691.43 |
| T50773 | 3135 | apolipoprotein C-IV | #N/A | #N/A | 94.77 | 43.61 | 169.6 | 8473.97 | 6484.47 | 7036.85 |
| T58756 | 3155 | EST | 13.39 | 0.00013 | 7.38 | -19.91 | 46.26 | 390.04 | 386.76 | 164.41 |
| T58775 | 3156 | small inducible cytokine subfamily A (Cys-Cys), member 16 | 21.18 | 0.00006 | 11.93 | -0.59 | 34.83 | 577.14 | 540.96 | 205.27 |
| T67520 | 3181 | EST | #N/A | #N/A | 52.46 | 49.25 | 28.02 | 105.56 | 113.95 | 38.23 |
| T67931 | 3183 | fibrinogen, B beta polypeptide | 49.55 | 0 | -22.74 | -22.4 | 23.54 | 1187.95 | 1000.67 | 692.18 |
| T69305 | 3196 | EST | #N/A | #N/A | -107.09 | -119.3 | 45.51 | 4052.6 | 4262.37 | 3025.26 |
| T71978 | 3204 | EST | 4.39 | 0.0017 | 41.46 | 58.86 | 43.93 | 218.38 | 208.73 | 89.39 |
| T72502 | 3207 | EST | 8.87 | 0.00009 | 24.11 | 24.41 | 28.19 | 308.87 | 271.27 | 179.15 |
| T73442 | 3212 | EST | 94.41 | 0 | 28.55 | 25.96 | 25.95 | 3170.29 | 3275.73 | 1073.74 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| T74608 | 3215 | hydroxyacid oxidase (glycolate oxidase) 1 | 14.03 | 0 | −3.14 | −1.78 | 23.12 | 360.97 | 328.7 | 194.85 |
| T82323 | 3230 | immunoglobulin superfamily, member 4 | 10.14 | 0 | 14.47 | 5.07 | 19.91 | 264.33 | 229.92 | 135.46 |
| T87224 | 3240 | EST | #N/A | #N/A | 584.24 | 451.54 | 184.49 | 909.33 | 851.86 | 431.47 |
| T90037 | 3245 | EST | 3.99 | 0.0016 | 23.17 | 25.82 | 23.62 | 150.67 | 107.18 | 126.19 |
| T90520 | 3248 | EST | 8.67 | 0.00072 | 9.05 | −7.07 | 25.65 | 306.39 | 362.5 | 204.34 |
| W15417 | 3472 | KIAA0699 protein | #N/A | #N/A | 30.82 | 20.85 | 38.03 | 83.24 | 81.29 | 49.83 |
| W48860 | 3534 | EST | #N/A | #N/A | 36.89 | 39 | 14.08 | 52.69 | 41.31 | 21.1 |
| W60186 | 3554 | EST | 3.24 | 0.00228 | 19.15 | 26.5 | 27.35 | 101.92 | 109.68 | 47.85 |
| W63741 | 3563 | EST | #N/A | #N/A | −11.85 | −13.73 | 14.25 | 28.54 | 17.1 | 44.58 |
| W67147 | 3565 | deleted in liver cancer 1 | 9.74 | 0.00002 | 16.09 | 9.11 | 24.66 | 282.59 | 235.29 | 169.33 |
| W67199 | 3566 | EST | 3.09 | 0.01528 | 30.05 | 35 | 12.16 | 123.27 | 117.99 | 90.47 |
| W72382 | 3581 | oxidative 3 alpha hydroxysteroid dehydrogenase; retinal dehydrogenase | #N/A | #N/A | 37.21 | 6.21 | 66.91 | 3403.46 | 3255.54 | 1538.23 |
| W72471 | 3582 | EST | #N/A | #N/A | 17.93 | 13.32 | 10.61 | 71.51 | 76.9 | 29.33 |
| W85765 | 3615 | EST | 3.83 | 0.00379 | 3.6 | 1.46 | 7.87 | 108.99 | 77.01 | 109.58 |
| W85886 | 3618 | EST | 3.46 | 0.00814 | −6.09 | −2.4 | 11.46 | 99.92 | 68.44 | 97.4 |
| W86431 | 3624 | protein C inhibitor (plasminogen activator inhibitor III) | 14.94 | 0.00152 | 3.16 | 5.55 | 12.03 | 606.44 | 395.34 | 590.7 |
| W86600 | 3625 | EST | 32.14 | 0 | 12.67 | 7.49 | 15.61 | 792.37 | 807.74 | 313.83 |
| W88946 | 3636 | putative glycine-N-acyltransferase | 58.26 | 0 | 2.16 | −22.13 | 39.9 | 1717.54 | 1821.77 | 502.55 |
| W90018 | 3639 | EST | #N/A | #N/A | −2.1 | 4.12 | 13.16 | 59.32 | 53.19 | 41.68 |
| W90396 | 3642 | EST | #N/A | #N/A | 16.1 | 15.26 | 11.11 | 23.65 | 22.93 | 10.28 |
| W94942 | 3658 | dual specificity phosphatase 10 | 7.23 | 0.00137 | 19.36 | 16.05 | 11.9 | 250.16 | 281.49 | 160.43 |
| W95041 | 3659 | EST | 12.79 | 0.00001 | 6.66 | 5.17 | 3.55 | 291.2 | 298.05 | 115.81 |
| Z38161 | 3881 | EST | 4.38 | 0.0011 | 11.84 | 12.14 | 6.32 | 111.16 | 107.62 | 80.11 |
| Z38910 | 3895 | EST | #N/A | #N/A | 0.68 | 2.75 | 12.7 | 35.49 | 32.21 | 23.55 |
| Z39394 | 3901 | EST | 10.11 | 0.00001 | 10.11 | 10.43 | 11.1 | 24.06 | 22.96 | 11.11 |
| Z39622 | 3907 | EST | 4.4 | 0.00001 | 19.65 | 21.87 | 11.97 | 110.87 | 115.21 | 36.19 |
| Z39976 | 3912 | EST | 5.76 | 0.00012 | 13.09 | 7.15 | 18.64 | 165.45 | 151.05 | 98.9 |
| Z40259 | 3916 | EST | 8.18 | 0.00002 | 14.39 | 8.61 | 11.98 | 218.4 | 223.24 | 122.06 |
| Z41271 | 3927 | ariadne, Drosophila, homolog of | #N/A | #N/A | 51.96 | 64.49 | 36.28 | 145.09 | 126.18 | 57.57 |
| Z41634 | 3931 | EST | #N/A | #N/A | 16.4 | 16.07 | 3 | 51.19 | 48.49 | 33 |
| AA001902 | 5 | KIAA0305 gene product | #N/A | #N/A | 14.88 | 17.06 | 8.8 | 29.11 | 28.6 | 23.36 |
| AA001903 | 6 | EST | #N/A | #N/A | 6.64 | 0.97 | 14.07 | 26.52 | 28.7 | 13.21 |
| AA004669 | 9 | EST | #N/A | #N/A | 8.66 | 10.77 | 8.65 | 33.32 | 25.36 | 31.12 |
| AA009719 | 20 | peroxisomal membrane protein 2 (22kD) | 47.12 | 0.00008 | −50.14 | −51.69 | 47.17 | 1370.32 | 1503.99 | 715.62 |
| AA010205 | 23 | EST | 7.41 | 0 | 14.43 | 17.64 | 14.87 | 187.55 | 154.99 | 92.13 |
| AA010360 | 24 | EST | 6.55 | 0.00027 | 12.5 | 14.77 | 8.62 | 169.99 | 135.98 | 129.2 |
| AA013095 | 33 | potassium voltage-gated channel, shaker-related subfamily, beta member 1, | #N/A | #N/A | 7.81 | 3.06 | 19.71 | 18.56 | 15.83 | 8.24 |
| AA015768 | 34 | EST | 15.3 | 0.00008 | 12.22 | 14.2 | 11.71 | 417.95 | 472.1 | 248.15 |
| AA016021 | 35 | ubiquitin-like 3 | #N/A | #N/A | 13.88 | 16.21 | 13.21 | 65.65 | 51.44 | 46.44 |
| AA018867 | 39 | EST | 42.87 | 0.00002 | 45.29 | 29.28 | 52.68 | 1944.56 | 2160.33 | 1142.41 |
| AA024511 | 46 | EST | 7.82 | #N/A | 7.82 | 3.08 | 12.06 | 62.54 | 58.34 | 27.73 |
| AA031360 | 67 | suppressor of Ty (S.cerevisiae) 3 homolog | #N/A | #N/A | 13.46 | 12.87 | 10.49 | 26.25 | 24.36 | 9.3 |
| AA034365 | 76 | EST | #N/A | #N/A | 119.5 | 39.46 | 171.27 | 216.28 | 159.86 | 152.39 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA039616 | 90 | EST | 9.36 | 0.00009 | 2.48 | −4.83 | 14.2 | 238.71 | 224.42 | 125.28 |
| AA040087 | 92 | EST | 4.13 | 0.00123 | 34.99 | 27.32 | 18.99 | 156.63 | 148.88 | 90.44 |
| AA040291 | 94 | KIAA0669 gene product | 3.55 | 0.00308 | 12.98 | 12.72 | 16.36 | 101.69 | 98.94 | 80.43 |
| AA046457 | 111 | EST | 3.2 | 0.00513 | 77.66 | 80.71 | 27.66 | 304.54 | 264.9 | 233.62 |
| AA056482 | 141 | EST | 4.82 | 0.00199 | 10.09 | 19.17 | 14.96 | 135.83 | 132.94 | 97.88 |
| AA074885 | 161 | macrophage receptor with collagenous structure | 11.05 | 0.00786 | 79.55 | 25.58 | 153.64 | 652.03 | 761.74 | 300.57 |
| AA075298 | 163 | EST | #N/A | #N/A | 46.45 | 36.93 | 42.61 | 129.13 | 121.57 | 70.36 |
| AA086201 | 185 | EST | 5.8 | 0.00012 | 21.29 | 24.75 | 14.37 | 177.39 | 182.95 | 95.51 |
| AA099225 | 206 | EST | 7.33 | 0.00062 | 4.37 | 1.35 | 6.08 | 212.68 | 163.45 | 194.31 |
| AA099571 | 209 | MD-2 protein | #N/A | #N/A | 10.12 | 4.61 | 19.11 | 55.77 | 62.72 | 31.71 |
| AA115933 | 231 | KIAA1098 protein | #N/A | #N/A | 8.62 | 6.46 | 10.77 | 33.88 | 34.38 | 16.63 |
| AA126059 | 246 | EST | 3.08 | 0.00706 | 102.34 | 104.33 | 40.8 | 380.92 | 280.71 | 316.4 |
| AA127514 | 253 | EST | 3.4 | 0.00045 | 11.36 | 10.76 | 6.8 | 74.71 | 76.5 | 36.07 |
| AA127646 | 254 | schwannomin interacting protein 1 | #N/A | #N/A | 6.76 | −0.26 | 12.36 | 44.24 | 41.48 | 20.02 |
| AA129465 | 263 | EST | #N/A | #N/A | 7.9 | 10.16 | 24.29 | 61.62 | 59.75 | 34.37 |
| AA133214 | 276 | meningioma expressed antigen 6 (coiled-coil proline-rich) | #N/A | #N/A | 3.16 | 7.46 | 14.35 | 65.17 | 56.11 | 51.18 |
| AA133457 | 280 | EST | #N/A | #N/A | 233.92 | 279.32 | 161.44 | 456.09 | 475.45 | 114 |
| AA136333 | 300 | zinc finger protein | #N/A | #N/A | 17.23 | 17.21 | 5.7 | 45.55 | 39.88 | 25.1 |
| AA167550 | 361 | EST | #N/A | #N/A | 4.38 | 7.64 | 6.98 | 28.69 | 26.29 | 16.06 |
| AA171529 | 365 | EST | #N/A | #N/A | −1.76 | −4.58 | 6.37 | 51.3 | 47.89 | 33.98 |
| AA179004 | 377 | EST | 14.34 | 0.00008 | −33.2 | −28.97 | 78.62 | 503.76 | 495.87 | 326.16 |
| AA191310 | 397 | protein phosphatase 2 (formerly 2A), regulatory subunitA (PR 65), beta isoform | 7.28 | 0 | 26.23 | 29.87 | 6.93 | 206.65 | 209.15 | 77.34 |
| AA195463 | 416 | EST | #N/A | #N/A | 5.44 | 6.92 | 3.77 | 51.81 | 64.76 | 26.85 |
| AA195515 | 417 | EST | #N/A | #N/A | 7.27 | 3.56 | 8.61 | 51.59 | 49.91 | 23.13 |
| AA197311 | 422 | intercellular adhesion molecule 1 (CD54), human rhinovirus receptor | 6.07 | 0.00053 | −19.49 | 1.63 | 43.72 | 154.69 | 175.76 | 83.19 |
| AA199603 | 423 | EST | #N/A | #N/A | 14.97 | 24.27 | 28.57 | 54.95 | 55.7 | 19.61 |
| AA223902 | 450 | EST | 9.91 | 0.00003 | 7.98 | −3.32 | 28.42 | 292.86 | 294.78 | 156.98 |
| AA226925 | 452 | EST | #N/A | #N/A | 11.94 | 9.22 | 7.55 | 49.69 | 48.29 | 27.49 |
| AA232114 | 463 | epoxide hydrolase 2, cytoplasmic | 24.34 | 0.00007 | 63.09 | 46.66 | 60.38 | 1455.28 | 1626.11 | 664.36 |
| AA233152 | 467 | EST | 12.95 | 0 | −29.09 | −28.01 | 34.42 | 299.54 | 291.48 | 156.26 |
| AA233797 | 473 | sperm associated antigen 7 | #N/A | #N/A | 54.72 | 50.23 | 11.36 | 116.14 | 127.3 | 54.24 |
| AA233837 | 474 | EST | 4.79 | 0.0034 | 18.96 | 19.45 | 40.67 | 214.77 | 118.28 | 278.62 |
| AA235288 | 494 | PTPL1-associated RhoGAP 1 | 3.7 | 0.00643 | 34.06 | 30.95 | 14.36 | 169.9 | 113.81 | 138.05 |
| AA250958 | 538 | EST | #N/A | #N/A | 53.41 | 53.63 | 22.55 | 99.74 | 114.71 | 55.23 |
| AA255903 | 573 | CD39-like 4 | 5.67 | 0.01687 | 72.5 | 39.23 | 108.92 | 383.56 | 374.1 | 211.92 |
| AA256341 | 578 | EST | 7.37 | 0.00091 | 17.81 | 2.34 | 28.59 | 280.57 | 324.08 | 170.98 |
| M279916 | 633 | EST | #N/A | #N/A | 61.08 | 56.18 | 25.7 | 115.24 | 102.89 | 58.77 |
| AA280413 | 638 | spleen focus forming virus (SFFV) proviral integration oncogene spi1 | 4.46 | 0.02062 | 64.05 | 69.15 | 51.55 | 339.15 | 353.53 | 235.59 |
| AA282541 | 661 | EST | #N/A | #N/A | 7.18 | 5.97 | 14.25 | 31.31 | 29.9 | 13.53 |
| AA343142 | 751 | EST | 20.87 | 0.00003 | −12.34 | −21.46 | 30.45 | 610.64 | 636.83 | 438.33 |
| AA397919 | 785 | EST | #N/A | #N/A | 108.63 | 144.35 | 84.25 | 243.79 | 199.62 | 185.4 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA398280 | 792 | EST | 12.43 | 0.00134 | −114.74 | −71.05 | 103.33 | 433.45 | 423.73 | 356.61 |
| AA404352 | 850 | EST | 7 | 0.00059 | 26.7 | 20.02 | 33.28 | 213.01 | 172.11 | 108 |
| AA406546 | 879 | EST | #N/A | #N/A | −1.45 | −7.89 | 15.19 | 46.62 | 50.65 | 26.97 |
| AA416936 | 910 | 5-methyltetrahydrofolate-homocysteine methyltransferase reductase | 4.98 | 0.00632 | 82.04 | 85.81 | 69.18 | 427.41 | 366.53 | 235.63 |
| AA424798 | 947 | EST | 17.45 | 0.00352 | 48.63 | 15.48 | 171.26 | 879.91 | 873.25 | 489.59 |
| AA428900 | 992 | EST | 7.01 | 0.00037 | 66.25 | 66.77 | 15.35 | 615.96 | 619.42 | 441.72 |
| AA429038 | 995 | EST | 3.29 | 0.00927 | 13.39 | 1.93 | 28.01 | 108.66 | 87.59 | 86.11 |
| AA434225 | 1035 | serum constituent protein | #N/A | #N/A | 1010.84 | 876.42 | 674.94 | 1022.5 | 746.49 | 681.49 |
| AA463729 | 1250 | EST | 4.07 | 0.00676 | 19.31 | 19.05 | 13.37 | 150.62 | 116.86 | 156.67 |
| AA479961 | 1320 | EST | #N/A | #N/A | 33.49 | 28.45 | 10.58 | 88.13 | 89.35 | 36.9 |
| AA490947 | 1383 | EST | #N/A | #N/A | 34.15 | 35 | 21.49 | 56.24 | 38.75 | 49.85 |
| AA599199 | 1444 | endothelin converting enzyme 1 | #N/A | #N/A | 187.77 | 108.97 | 225.55 | 695.29 | 680.26 | 375.12 |
| AA621315 | 1521 | catenin (cadherin-associated protein), alpha-like 1 | #N/A | #N/A | 191.28 | 141.04 | 182.69 | 313.23 | 281.93 | 134.57 |
| C20982 | 1582 | aldehyde dehydrogenase 5 family, member A1 (succinate-semialdehyde dehydrogenase) | #N/A | #N/A | 68.8 | 85.38 | 28.73 | 104.44 | 88.12 | 66.28 |
| C21130 | 1583 | EST | 8.79 | 0.00008 | 17.56 | 8.6 | 19.19 | 277.18 | 238.8 | 188.55 |
| D11835 | 1598 | low density lipoprotein receptor (familial hypercholesterolemia) | 21.76 | 0.00307 | 76.38 | 23.21 | 131.25 | 895.7 | 910.39 | 322.98 |
| D45714 | 1664 | EST | 5.64 | 0.00384 | 34.3 | 29.86 | 13.09 | 301.07 | 218.14 | 282.7 |
| F04944 | 1795 | acyl-Coenzyme A oxidase | 4.01 | 0.00242 | 40.92 | 33.99 | 28.07 | 191.04 | 192.25 | 99.98 |
| F10276 | 1814 | dual specificity phosphatase 6 | 8.13 | 0.0001 | 19.64 | 13.06 | 12.33 | 240.65 | 275.65 | 138.17 |
| H11739 | 1876 | glycine dehydrogenase (decarboxylating; glycine decarboxylase, glycine cleavage system protein P) | 10.33 | 0.00023 | −21.2 | −37.69 | 28.32 | 290.05 | 210.37 | 244.67 |
| H68239 | 1983 | EST | #N/A | #N/A | 26.96 | 17.94 | 15.81 | 66.76 | 66.18 | 51.67 |
| H79820 | 2004 | EST | 3.25 | 0.01466 | 10.64 | 2 | 22.28 | 113.3 | 113.19 | 95.96 |
| H82966 | 2011 | apolipoprotein B (including Ag(x) antigen) | 3.42 | 0.00769 | 0.2 | 1 | 15.26 | 100.93 | 77.36 | 96.78 |
| H96392 | 2053 | EST | #N/A | #N/A | 12.6 | 9.93 | 33.15 | 35.98 | 53.46 | 42.74 |
| N22938 | 2452 | serum amyloid A4, constitutive | 35.39 | 0.00128 | 163.4 | 145.31 | 160.24 | 4244.44 | 3330.35 | 2358.25 |
| N32071 | 2490 | EST | 8.75 | 0.00006 | 40.89 | 43.12 | 15.37 | 421.21 | 488.49 | 238.4 |
| N47469 | 2521 | EST | 3.34 | 0.00329 | 20.35 | 13.91 | 20.65 | 104.74 | 99.87 | 61.84 |
| N48155 | 2524 | EST | #N/A | #N/A | 17.08 | 16.77 | 14.66 | 97.37 | 54.69 | 99.7 |
| N51117 | 2543 | EST | 9.68 | 0.00081 | 8.23 | 4.5 | 11.88 | 327.53 | 296.4 | 266.42 |
| N52845 | 2553 | EST | 5.53 | 0.00088 | 28.56 | 30.14 | 14.95 | 219.38 | 230.31 | 149.67 |
| N53757 | 2559 | EST | 3.97 | 0.00255 | 99.49 | 80.7 | 56.09 | 365.45 | 324.21 | 118.42 |
| N55272 | 2573 | EST | #N/A | #N/A | 22.71 | 13.6 | 24.4 | 45.08 | 47.45 | 14.77 |
| N59550 | 2587 | EST | 25.56 | 0.00024 | 19.9 | 2.53 | 65.91 | 855.88 | 774.72 | 358.3 |
| N64017 | 2605 | EST | 5.27 | 0.00022 | 5.45 | 8.71 | 8.71 | 122.34 | 135.27 | 55.58 |
| N67974 | 2629 | activating transcription factor 4 (tax-responsive enhancer element B67) | #N/A | #N/A | 5.67 | −0.08 | 15.97 | 82.1 | 74.13 | 59.47 |
| N70358 | 2656 | growth hormone receptor | 34.35 | 0 | 20.93 | 29.26 | 36.06 | 1449.57 | 1157.97 | 1115.22 |
| N73561 | 2675 | EST | 12.96 | 0.00011 | 17.04 | 4.48 | 25.06 | 516.79 | 458.57 | 393.69 |
| N80129 | 2702 | metallothionein 1L | 66.48 | 0.00415 | 179.8 | 104.5 | 643.06 | 10421.47 | 6358.88 | 9618.38 |
| N93470 | 2735 | EST | 5.27 | 0.00022 | 14.01 | 8.69 | 17.09 | 77.86 | 66.84 | 70.45 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| R02365 | 2754 | glucose-6-phosphatase, catalytic (glycogen storage disease type I, von Gierke disease) | 17.17 | 0.00124 | 0.92 | −5.3 | 9.39 | 768.72 | 444.03 | 841.02 |
| R06977 | 2774 | glucokinase (hexokinase 4) regulatory protein | 6.1 | 0.00049 | −47.7 | −38.97 | 37.79 | 152.22 | 150.69 | 87.15 |
| R43174 | 2847 | paraoxonase 1 | 74.04 | 0.00038 | 47.94 | −8.83 | 119.68 | 2926.85 | 3104.07 | 1318.41 |
| R67970 | 2939 | gamma-glutamyl carboxylase | 9.45 | 0.00212 | 85.44 | 59.33 | 76.67 | 655.11 | 692.66 | 267.95 |
| R98105 | 3010 | EST | #N/A | #N/A | 132.16 | 97.16 | 141.15 | 373.83 | 342.91 | 215.89 |
| R98624 | 3012 | EST | 21.32 | 0 | 15.01 | 4.48 | 22.97 | 686.81 | 542.22 | 466.97 |
| R99591 | 3015 | CD5 antigen-like (scavenger receptor cysteine rich family) | 9.52 | 0.00006 | 87.08 | 72.59 | 28.25 | 1035.39 | 904.92 | 691.83 |
| T48075 | 3129 | hemoglobin, alpha 1 | 32.56 | 0.00172 | 246.19 | 164.89 | 271.65 | 7193.85 | 5199.28 | 6317.01 |
| T51617 | 3137 | solute carrier family 22 (extraneuronal monoamine transporter), member 3 | 17.67 | 0.00018 | 29.08 | 19.44 | 56.17 | 669.34 | 725.25 | 402.58 |
| T51930 | 3138 | EST | 9.99 | 0.00066 | 8.27 | 9.41 | 5.97 | 325.48 | 218.59 | 298.12 |
| T67705 | 3182 | asialoglycoprotein receptor 2 | 31.6 | 0.00705 | 168.64 | 37.91 | 284.26 | 2403.76 | 2437.4 | 683.22 |
| T68711 | 3187 | EST | 37.65 | 0.00036 | 19.73 | −26.69 | 95.05 | 1388.67 | 1074.67 | 890.91 |
| T69284 | 3195 | mannose-binding lectin (protein C) 2, soluble (opsonic defect) | 36.53 | 0 | 9.82 | 0.32 | 17.14 | 1147.2 | 618.07 | 972.57 |
| T72171 | 3205 | thyroxin-binding globulin | 10.41 | 0.00163 | 5.48 | −20.52 | 54.58 | 492.89 | 371.71 | 454.89 |
| T72906 | 3209 | EST | 7.56 | 0.00062 | 4.88 | 3.04 | 14.04 | 233.73 | 199.26 | 211.99 |
| T73739 | 3213 | alanine-glyoxylate aminotransferase (oxalosis I; hyperoxaluria I; glycolicaciduria; serine-pyruvate aminotransferase) | 16.18 | 0.00277 | 1891.22 | 896.45 | 2229.6 | 26094.38 | 15281.08 | 25947.4 |
| W42429 | 3506 | EST | #N/A | #N/A | 98.32 | 80.07 | 52.23 | 252.63 | 300.68 | 162.35 |
| W58756 | 3551 | EST | 12.17 | 0.00087 | 93.37 | 88.97 | 71.48 | 1363.71 | 1064.26 | 1032.27 |
| W70131 | 3574 | EST | #N/A | #N/A | 108.21 | 30.68 | 183.05 | 118.49 | 100.66 | 53.4 |
| W72044 | 3577 | insulin induced gene 1 | 24.58 | 0.00001 | 41.6 | 36.28 | 36.46 | 1133.09 | 940.16 | 723.6 |
| W72079 | 3578 | EST | 6.36 | 0.00641 | 46.78 | 17.94 | 66.71 | 261.7 | 214.62 | 175.87 |
| W72972 | 3584 | EST | 5.61 | 0.00939 | 44.7 | 26.44 | 80.59 | 277.4 | 270.63 | 183.07 |
| W73382 | 3588 | EST | #N/A | #N/A | 62.97 | 39.05 | 67.26 | 87.32 | 89.49 | 28.17 |
| W85847 | 3616 | EST | 7.28 | 0.00024 | 4.15 | 5.29 | 9.26 | 187.31 | 160.02 | 130.73 |
| W87454 | 3629 | homogentisate 1,2-dioxygenase (homogentisate oxidase) | 7.93 | 0.00149 | 11.36 | 5.83 | 39.02 | 336.07 | 275.03 | 315.24 |
| W92148 | 3647 | kininogen | 51.09 | 0.00376 | 220.31 | 42.96 | 427.59 | 3697.54 | 4015.04 | 1444.99 |
| Z41356 | 3929 | EST | #N/A | #N/A | 4.46 | 15.94 | 28.44 | 82.7 | 48.14 | 71.73 |
| AA112209 | 223 | acyl-Coenzyme A dehydrogenase, long chain | 3.37 | 0.00084 | 29.77 | 28.31 | 11.33 | 116 | 100.18 | 66.07 |
| AA149253 | 323 | EST | 5.12 | 0.00863 | 78.65 | 75.3 | 61.14 | 401.77 | 301.06 | 333.03 |
| AA211418 | 434 | EST | #N/A | #N/A | 65.81 | 70.1 | 37.84 | 223.56 | 214.42 | 151.4 |
| AA227480 | 456 | EST | 3.31 | 0.02413 | 48 | 62.07 | 33.49 | 195.79 | 162.34 | 182.76 |
| AA235507 | 498 | pim-2 oncogene | 3.28 | 0.00249 | 22.14 | 37.31 | 26.61 | 111.91 | 126.75 | 58.39 |
| AA257057 | 586 | golgi autoantigen, golgin subfamily a, 5 | 8.11 | 0.00379 | 42.36 | 16.78 | 47.02 | 451.86 | 462.6 | 343.05 |
| AA258353 | 593 | EST | 5.28 | 0.00193 | 71.76 | 84 | 37.77 | 347.7 | 363.14 | 106.2 |
| AA279158 | 623 | EST | #N/A | #N/A | 50 | 46.97 | 19.41 | 87.9 | 72.44 | 38.36 |
| AA282956 | 664 | EST | #N/A | #N/A | 0.28 | −9.07 | 30.81 | 59.89 | 51.54 | 35.5 |
| AA285053 | 681 | EST | 6.95 | 0.00125 | 12.65 | 14.54 | 23.53 | 238.16 | 242.27 | 169.12 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA312946 | 731 | EST | 9.21 | 0.00106 | 12.32 | 13.78 | 12.24 | 300.22 | 304.56 | 213.18 |
| AA344866 | 752 | complement component 8, gamma polypeptide | 7.28 | 0.00206 | 292.65 | 305.28 | 176.61 | 1845.16 | 1679.29 | 561.04 |
| AA363203 | 761 | EST | #N/A | #N/A | 35.7 | 40.27 | 34.51 | 78.45 | 75.11 | 47.8 |
| AA381125 | 772 | EST | 15.48 | 0 | 17.66 | 13.82 | 13.2 | 412.26 | 344.45 | 217.56 |
| AA400030 | 806 | EST | 3.98 | 0.00088 | 8.99 | 12.21 | 11.35 | 97.83 | 115.15 | 52.04 |
| AA400080 | 807 | EST | #N/A | #N/A | 25.33 | 23.57 | 27.54 | 61.21 | 60.21 | 29.91 |
| AA400258 | 812 | EST | 11.89 | 0.00478 | 85.31 | 36.81 | 139.93 | 827.48 | 884.35 | 562.14 |
| AA400934 | 824 | EST | 4.98 | 0.02013 | 75.44 | 67.21 | 77.7 | 305.09 | 307.45 | 125.76 |
| AA401562 | 830 | EST | 50.45 | 0.00301 | 155.46 | 63.87 | 317.6 | 3745.71 | 3628.4 | 1635.98 |
| AA401825 | 831 | EST | #N/A | #N/A | 24.3 | 26.82 | 18.04 | 65.22 | 57.51 | 46.54 |
| AA405494 | 858 | EST | #N/A | #N/A | 10.03 | 9.53 | 7.62 | 59.95 | 44.88 | 50.8 |
| AA412068 | 896 | EST | #N/A | #N/A | 30.52 | 29.79 | 13.4 | 81.26 | 74.52 | 35.68 |
| AA417078 | 916 | EST | 4.1 | 0.00414 | 36.75 | 35.35 | 15.12 | 189.88 | 171.1 | 150.02 |
| AA419608 | 925 | EST | 9.19 | 0.00005 | 51.89 | 51.37 | 25.93 | 524.34 | 571.05 | 296.46 |
| AA419622 | 926 | EST | 4.62 | 0.00386 | 24.88 | 17.15 | 26 | 158.88 | 162.5 | 112.57 |
| AA421561 | 933 | insulin-like growth factor 2 (somatomedin A) | 9.98 | 0.00007 | 79.46 | 77.34 | 41.63 | 921.91 | 703.16 | 679.72 |
| AA429651 | 1002 | KIAA0871 protein | #N/A | #N/A | 15.52 | 13.25 | 17.03 | 44.75 | 41.91 | 28.67 |
| AA432166 | 1030 | succinate dehydrogenase complex, subunit C, integral membrane protein, 15kD | #N/A | #N/A | 10.94 | 14.1 | 42.99 | 33.86 | 42.75 | 27.46 |
| AA435753 | 1045 | EST | 4.71 | 0.00078 | 198.97 | 193.33 | 110.58 | 970.79 | 830.39 | 567.79 |
| AA443934 | 1083 | GTP-binding protein Rho7 | 3.09 | 0.00214 | 30.32 | 35.97 | 13.76 | 115.87 | 113.7 | 66.78 |
| AA446342 | 1088 | seven in absentia (Drosophila) homolog 1 | 4.84 | 0.00015 | 9.92 | 9.12 | 4.58 | 110.73 | 115.89 | 53.13 |
| AA448300 | 1116 | FXYD domain-containing ion transport regulator 1 (phospholemman) | 0.00001 | 118.64 | 24.97 | 70.34 | 2849.54 | 2905.51 | 994.41 | 789.64 |
| AA452158 | 1141 | ras homolog gene family, member B | 28.96 | 0.00064 | -103.87 | -106.99 | 71.68 | 1071.9 | 1164.8 | 70.02 |
| AA453770 | 1157 | EST | 6.04 | 0.00524 | 46.33 | 25.95 | 53.45 | 217.46 | 212.4 | 258.82 |
| AA454177 | 1164 | EST | 10.3 | 0.0008 | 9.16 | 14.72 | 11.39 | 324.16 | 253.23 | 66.93 |
| AA455896 | 1181 | glypican 1 | 3.46 | 0.00887 | 16.1 | 4.35 | 40.39 | 120.52 | 137.84 | 68.09 |
| AA456326 | 1191 | EST | 3.35 | 0.00489 | 17.08 | 2.74 | 30.38 | 111.5 | 102.17 | 49.27 |
| AA456845 | 1198 | KIAA0680 gene product | #N/A | #N/A | 23.95 | 17.11 | 17.99 | 67.15 | 63.46 | 39.92 |
| AA459256 | 1212 | lectin, mannose-binding, 1 | 3.01 | 0.00094 | 3.83 | 8.1 | 8.32 | 65.91 | 63.36 | 108.17 |
| AA460661 | 1229 | EST | 7.02 | 0.00053 | -1.52 | -6.03 | 15.81 | 184.62 | 198.21 | 46.64 |
| AA463876 | 1252 | EST | 3.31 | 0.00109 | 9.81 | 11.89 | 10.39 | 73.95 | 73.76 | 52.43 |
| AA465381 | 1272 | EST | #N/A | #N/A | 88.83 | 36.24 | 130.22 | 102.73 | 113.07 | 97.49 |
| AA479968 | 1321 | arylsulfatase A | 9.01 | 0.00224 | 37.97 | 20.36 | 45.8 | 331.32 | 312.63 | 63.6 |
| AA480997 | 1324 | MADS box transcription enhancer factor 2, polypeptide A (myocyte enhancer factor 2A) | #N/A | #N/A | 16 | 20.58 | 9.93 | 68.53 | 55.62 | 23.22 |
| AA481057 | 1325 | EST | #N/A | #N/A | 16.3 | 18.55 | 8.1 | 33.83 | 37.89 | 55.07 |
| AA486407 | 1347 | EST | #N/A | #N/A | 33.22 | 47.88 | 28.61 | 81.72 | 97.02 | 95.59 |
| AA486567 | 1350 | EST | 5 | 0.00002 | 4.65 | 2.5 | 21.62 | 131.53 | 98.76 | 31.84 |
| AA486794 | 1351 | EST | #N/A | #N/A | 49.57 | 52.25 | 18.73 | 78.8 | 72.55 | 119.11 |
| AA487503 | 1356 | EST | 8.85 | 0.00012 | 13.8 | 17.99 | 8.76 | 220.45 | 255.47 | 54.46 |
| AA490882 | 1381 | EST | 3.29 | 0.00319 | 20.67 | 13.84 | 27.06 | 100.67 | 98.47 | 33.37 |
| AA490890 | 1382 | EST | 3.02 | 0.00007 | 20.26 | 21.34 | 9.23 | 75.61 | 65.02 | 17.68 |
| AA496927 | 1402 | EST | #N/A | #N/A | 24.89 | 26.85 | 9.47 | 58.2 | 58.42 | |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| AA598685 | 1435 | lectin, galactoside-binding, soluble, 8 (galectin 8) | #N/A | #N/A | 16.45 | 11.35 | 11.87 | 55.9 | 55.08 | 42.18 |
| AA599365 | 1449 | decorin | #N/A | #N/A | 36.41 | 34.43 | 21.53 | 83.84 | 84.81 | 43.41 |
| AA600248 | 1461 | EST | #N/A | #N/A | 59.11 | 59.91 | 32.47 | 80.55 | 71.14 | 61.42 |
| AA609715 | 1488 | EST | #N/A | #N/A | −1.49 | −3.92 | 10.63 | 29.09 | 33.14 | 17.26 |
| AA621796 | 1531 | kinesin family member 3B | 4.44 | 0.00032 | 21.81 | 23.64 | 8.64 | 128.01 | 124.81 | 70.04 |
| C20653 | 1578 | EST | 10.59 | 0.00001 | 7.99 | 2.12 | 11.85 | 251.82 | 299.09 | 106.09 |
| D11802 | 1597 | angiotensinogen | 5.65 | 0.00009 | 55.88 | 52.43 | 25.14 | 319.73 | 291.02 | 132.07 |
| D45529 | 1662 | EST | 3.82 | 0.00193 | 12.24 | −3.36 | 29.18 | 126.63 | 109.06 | 70.64 |
| D59954 | 1698 | EST | 6.7 | 0 | 6.09 | 9.79 | 34.83 | 184.48 | 158.33 | 79.55 |
| D60769 | 1703 | KIAA0096 protein | 4.31 | 0.00142 | 13.44 | 13.91 | 10.95 | 119.96 | 107.2 | 86.36 |
| F10380 | 1816 | butyrobetaine (gamma), 2-oxoglutarate dioxygenase (gamma-butyrobetaine hydroxylase) | #N/A | #N/A | 36.92 | 34.01 | 13.56 | 106.49 | 93.71 | 83.35 |
| F10874 | 1823 | EST | 4.19 | 0.00025 | 233.85 | 209.96 | 107.99 | 1016.95 | 990.04 | 477.31 |
| H03348 | 1833 | claudin 1 | 5.77 | 0.0001 | 1.48 | 7.75 | 17.79 | 135.1 | 134.05 | 75.43 |
| H16098 | 1885 | EST | #N/A | #N/A | 45.29 | 37.73 | 26.92 | 87.28 | 94.49 | 38.15 |
| H17472 | 1888 | EST | #N/A | #N/A | 12.2 | 9.54 | 8.57 | 31.08 | 31.66 | 13.28 |
| H47838 | 1936 | carboxypeptidase B2 (plasma) | 16.74 | 0.00002 | −26.99 | −41.82 | 25.87 | 401.55 | 412.78 | 188.81 |
| H56584 | 1951 | 4-nitrophenylphosphatase domain and non-neuronal SNAP25-like 1 | 9.5 | 0 | 1.95 | 10.13 | 31.43 | 223.03 | 233.37 | 105.28 |
| H69138 | 1986 | v-Ki-ras2 Kirsten rat sarcoma 2 viral oncogene homolog | 6.76 | 0.00142 | 42.88 | 30.87 | 38.35 | 328.51 | 313.13 | 218.8 |
| H70627 | 1990 | EST | #N/A | #N/A | 17.89 | 17.62 | 8.85 | 42.72 | 41.34 | 11.7 |
| H73535 | 1996 | EST | 6.89 | 0.00202 | 154.24 | 97.36 | 149.45 | 912.39 | 956.58 | 383.35 |
| H77494 | 1999 | EST | #N/A | #N/A | 9.65 | 6.64 | 15.53 | 42.67 | 47.73 | 27.54 |
| H81070 | 2006 | RNA helicase-related protein | 25.74 | 0.00126 | 93.43 | 62.01 | 121.29 | 2044.42 | 2051.11 | 615.84 |
| H81964 | 2008 | SEC14 (S. cerevisiae)-like 1 | #N/A | #N/A | 9.95 | 15.7 | 12.54 | 29.9 | 21.14 | 20.56 |
| H82424 | 2009 | EST | #N/A | #N/A | 41.99 | 48.17 | 21.1 | 65.11 | 69.41 | 36.73 |
| H82735 | 2010 | NOT3 (negative regulator of transcription 3, yeast) homolog | #N/A | #N/A | −1.13 | 6.14 | 29.78 | 58.77 | 54.86 | 35.76 |
| H83109 | 2012 | EST | 16.55 | 0.00001 | 2.74 | 4.43 | 21.21 | 417.46 | 421.97 | 224.35 |
| H93562 | 2038 | proline synthetase co-transcribed (bacterial homolog) | 3.17 | 0.00113 | 20.83 | 14.13 | 20.46 | 89.3 | 84.36 | 37.72 |
| H93745 | 2040 | GS2 gene | #N/A | #N/A | 4.52 | 8.01 | 8.31 | 47.92 | 46.53 | 28.87 |
| H96897 | 2056 | KIAA0336 gene product | #N/A | #N/A | 35.22 | 19.98 | 42.05 | 48.46 | 50.39 | 33.36 |
| H97587 | 2060 | endothelin receptor type B | #N/A | #N/A | −5.07 | −3.35 | 14.02 | 39.65 | 36.54 | 21.7 |
| H97670 | 2061 | EST | #N/A | #N/A | 23.31 | 29.71 | 31.35 | 101.35 | 128.08 | 56.78 |
| H99393 | 2076 | endothelin receptor type B | 3.43 | 0.00093 | 4.63 | 9.33 | 11.96 | 79.18 | 70.67 | 42.71 |
| N21626 | 2444 | EST | #N/A | #N/A | 29.77 | 24.63 | 25.09 | 59.18 | 46.15 | 33.56 |
| N35247 | 2499 | EST | #N/A | #N/A | 39.9 | 33.56 | 15.03 | 117.08 | 116.14 | 57.05 |
| N54311 | 2563 | EST | 4.82 | 0.00183 | 9.77 | 9.36 | 25.17 | 160.29 | 130.17 | 124.7 |
| N57934 | 2576 | formiminotransferase cyclodeaminase | 13.81 | 0.00171 | 806.55 | 477.9 | 939.39 | 9051.2 | 6373.16 | 8542.52 |
| N59532 | 2584 | aminomethyltransferase (glycine cleavage system protein T) 6.73 | 0.00005 | 12.43 | 2.55 | 17.66 | 196.37 | 155.84 | 122.13 | 35.76 |
| N62523 | 2591 | hepatic leukemia factor | 5.02 | 0.00087 | 9.04 | 6.67 | 16.46 | 144.8 | 148.62 | 85.03 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| N63172 | 2598 | cell division cycle 42 (GTP-binding protein, 25kD) | #N/A | #N/A | 26.88 | 33.1 | 24.75 | 60.99 | 57.64 | 40.01 |
| N66130 | 2613 | progesterone membrane binding protein | 3.98 | 0.0106 | 29.02 | 21.05 | 33.88 | 172.14 | 181.78 | 114.84 |
| N67009 | 2621 | prion protein (p27-30) (Creutzfeld-Jakob disease, Gerstmann-Strausler-Scheinker syndrome, fatal familial insomnia) | 3.55 | 0.00956 | 25.95 | 11.35 | 38.17 | 122.85 | 124.39 | 65.69 |
| N67105 | 2623 | EST | 5.01 | 0.00176 | -0.75 | 0.21 | 16.38 | 143.36 | 102.9 | 121.4 |
| N67876 | 2627 | insulin-like growth factor 1 (somatomedin C) | 8.89 | 0.00042 | 11.81 | 15.88 | 8.82 | 267.41 | 145.79 | 238.35 |
| N68133 | 2632 | EST | #N/A | #N/A | 2.35 | -5.53 | 16.59 | 58.69 | 37.21 | 57.82 |
| N68596 | 2635 | betaine-homocysteine methyltransferase | 40.99 | 0 | -6.75 | -13.81 | 19.15 | 1061.81 | 1013.27 | 574.42 |
| N72200 | 2668 | EST | #N/A | #N/A | 12.93 | 14.15 | 14.26 | 57.8 | 56.14 | 30.12 |
| R05309 | 2758 | EST | 3.72 | 0.0008 | 21.94 | 13.92 | 18.75 | 96.81 | 100.54 | 31.73 |
| R06271 | 2765 | EST | 6.14 | 0.00063 | 23.1 | 18.95 | 21.07 | 208.75 | 221.65 | 107.72 |
| R06273 | 2766 | EST | #N/A | #N/A | 138 | 103.77 | 75.66 | 235.98 | 183.78 | 122.56 |
| R31104 | 2810 | EST | #N/A | #N/A | -6.45 | 0.74 | 37.65 | 32.27 | 26.77 | 13.57 |
| R40395 | 2840 | lecithin-cholesterol acyltransferase | 37.33 | 0.00032 | 0.98 | -46.23 | 77.82 | 1192.03 | 1230.66 | 281.28 |
| R40556 | 2842 | EST | 3.57 | 0.00184 | 8.98 | 8.28 | 11.75 | 91.55 | 95.59 | 58.66 |
| R40946 | 2844 | crystallin, zeta (quinone reductase) | 6.14 | 0.00156 | 18.65 | 19.52 | 14.3 | 205.48 | 220.3 | 137.27 |
| R45480 | 2862 | cyclin K | #N/A | #N/A | 27.21 | 17.36 | 21.39 | 71.04 | 79.77 | 50.88 |
| R62519 | 2925 | EST | 10.83 | 0.00243 | 73.01 | 104.54 | 56.5 | 707.38 | 751.42 | 357.22 |
| T56281 | 3150 | RNA helicase-related protein | 32.34 | 0.00002 | 71.16 | 62.87 | 44.81 | 2132.07 | 2146.52 | 824.76 |
| T59148 | 3157 | carbamoyl-phosphate synthetase 1, mitochondrial | 88.89 | 0 | 17.1 | 2.26 | 49.29 | 3384.09 | 3845.28 | 2295.81 |
| T61256 | 3161 | ketohexokinase (fructokinase) | 13.59 | 0.00425 | 55.8 | 29.78 | 120.62 | 752.99 | 846.1 | 315.74 |
| T61654 | 3165 | apolipoprotein A-I | #N/A | #N/A | 66.98 | -33.89 | 208.52 | 9388.4 | 4297.02 | 12058.3 |
| T64933 | 3173 | EST | #N/A | #N/A | 1.58 | 10.35 | 17.94 | 52.88 | 40.46 | 54.68 |
| T65443 | 3174 | EST | 11.15 | 0.00006 | 10.45 | 9.99 | 13.16 | 70.03 | 75.01 | 29 |
| T66189 | 3177 | glutaryl-Coenzyme A dehydrogenase | 8.61 | 0.00003 | 17.08 | 20.49 | 23.82 | 269.19 | 301.13 | 136.96 |
| T68855 | 3188 | EST | 34.04 | 0 | 8.38 | 6.98 | 9 | 800.27 | 911.26 | 406.27 |
| T69020 | 3192 | EST | 5.39 | 0.00383 | 32.69 | 17.15 | 46.31 | 202.05 | 208.64 | 90.02 |
| T69164 | 3194 | EST | 4.38 | 0.00548 | 34.31 | 17.81 | 30.85 | 173.2 | 167.2 | 85.34 |
| T74542 | 3214 | UDP glycosyltransferase 2 family, polypeptide B10 | 32.36 | 0.00004 | 27.96 | 25.04 | 64.23 | 1374.78 | 1445.94 | 869.3 |
| T84084 | 3233 | EST | #N/A | #N/A | 21.47 | 21.35 | 9.96 | 68.96 | 66.69 | 27.4 |
| T84491 | 3234 | CUG triplet repeat, RNA-binding protein 2 | #N/A | #N/A | 32.84 | 34.93 | 8.15 | 79.08 | 80.41 | 33.03 |
| T86482 | 3237 | transferrin | 11.15 | 0.00006 | 7.6 | 9.41 | 12.34 | 316.82 | 197.03 | 302.36 |
| T91161 | 3252 | EST | 3.48 | 0.00002 | 9.95 | 2.64 | 11.55 | 77.85 | 70.8 | 30.28 |
| W45560 | 3522 | EST | 5.06 | 0.00996 | 86.81 | 62.95 | 81.92 | 369.61 | 354.89 | 158.02 |
| W79422 | 3601 | fumarylacetoacetate | 14.94 | 0.00059 | -18.4 | -19.27 | 33.52 | 467.37 | 554.19 | 306.71 |
| W87480 | 3630 | STAT induced STAT inhibitor-2 | 3.24 | 0.01063 | 31.91 | 26.07 | 30.44 | 129.06 | 119.73 | 80.94 |
| W87606 | 3632 | protein Z, vitamin K-dependent plasma glycoprotein | 9.23 | 0.00085 | 2.53 | -1.74 | 9.98 | 268.59 | 280.44 | 184.7 |
| Z38192 | 3882 | EST | 3.35 | 0.00184 | -0.28 | -4.75 | 17.86 | 87.12 | 87.23 | 52.58 |
| Z39833 | 3910 | GTP-binding protein | 16.89 | 0.00034 | 35.79 | 41.07 | 84.59 | 957.61 | 1080.1 | 674.72 |
| AF000573 | 1543 | homogentisate 1,2-dioxygenase (homogentisate oxidase) | 13.76 | 0.00002 | 9.05 | 13.23 | 17.33 | 380.3 | 348.9 | 256.4 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| D12485 | 1600 | phosphodiesterase I/nucleotide pyrophosphatase 1 (homologous to mouse Ly-41 antigen) | 4.57 | 0.00008 | −2.69 | −0.53 | 9.86 | 101.7 | 90.07 | 46.62 |
| D14664 | 1616 | KIAA0022 gene product | 8.98 | 0.00011 | 14.15 | 13.51 | 9.07 | 233.08 | 248.97 | 111.44 |
| D14686 | 1617 | aminomethyltransferase (glycine cleavage system protein T) | #N/A | #N/A | 76.93 | 90.12 | 29.68 | 171.07 | 190.08 | 34.32 |
| D14695 | 1618 | KIAA0025 gene product; MMS-inducible gene | 6.48 | 0 | 28.53 | 28.21 | 12 | 196.04 | 197.12 | 77.25 |
| D16350 | 1620 | SA (rat hypertension-associated) homolog | 3.83 | 0.00117 | 27.34 | 29.05 | 12.27 | 128.95 | 133.42 | 74.27 |
| D31716 | 1647 | basic transcription element binding protein 1 | 5.35 | 0.00086 | 16.08 | 23.65 | 17.64 | 166.06 | 203.79 | 87.22 |
| D31815 | 1648 | regucalcin (senescence marker protein-30) | 10.55 | 0.00037 | 11.48 | 10.25 | 7 | 298.48 | 281.03 | 183.56 |
| D49742 | 1668 | hyaluronan-binding protein 2 | 18.13 | 0.00012 | 11.38 | −0.72 | 41.45 | 509.66 | 531.78 | 127.5 |
| D50582 | 1670 | potassium inwardly-rectifying channel, subfamily J, member 11 | #N/A | #N/A | 61.44 | 65.47 | 28.34 | 70.38 | 76.35 | 25.4 |
| D63160 | 1709 | ficolin (collagen/fibrinogen domain-containing lectin) 2 (hucolin) | 4.01 | 0.00391 | 51.13 | 46.11 | 30.07 | 219.26 | 228.53 | 125.06 |
| D76435 | 1716 | Zic family member 1 (odd-paired Drosophila homolog) | #N/A | #N/A | 7.52 | 9.44 | 7.51 | 28.48 | 22.05 | 16.54 |
| D78011 | 1717 | dihydropyrimidinase | 21.37 | 0.00003 | 22.34 | 11.34 | 31.83 | 640.3 | 680.03 | 206.48 |
| D85181 | 1750 | sterol-C5-desaturase (fungal ERG3, delta-5-desaturase)-like | 9.56 | 0.00005 | 31.54 | 25.11 | 23.09 | 350.04 | 388.34 | 151.37 |
| D85433 | 1751 | EST | #N/A | #N/A | 45.14 | 48.1 | 33.75 | 45.46 | 44.56 | 22.01 |
| D86983 | 1758 | p53-responsive gene 2 | #N/A | #N/A | 44.18 | 43.24 | 14.93 | 56.19 | 53 | 16.12 |
| D87075 | 1760 | solute carrier family 23 (nucleobase transporters), member 1 | 4.15 | 0.00067 | 5.77 | −0.83 | 26.24 | 119.77 | 104.75 | 72.62 |
| D90282 | 1769 | carbamoyl-phosphate synthetase 1, mitochondrial | 27.29 | 0.00002 | 8.24 | 12.24 | 8.02 | 712.98 | 819.32 | 415.69 |
| H46990 | 1933 | cytochrome P450, subfamily IIE (ethanol-inducible) | 3.2 | 0.00095 | −0.27 | −6.33 | 16.23 | 72.1 | 71.1 | 37.01 |
| HG1148-HT1148 |  | EST | 17.51 | 0.00024 | 11.81 | 2.35 | 49.19 | 501.82 | 482.3 | 169.87 |
| HG2167-HT2237 |  | A kinase (PRKA) anchor protein 13 | #N/A | #N/A | 12.53 | 10.98 | 18.36 | 61.94 | 62.5 | 16.73 |
| HG2755-HT2862 |  | plastin 3 (T isoform) | 11.01 | #N/A | 50.51 | 23.74 | 81.64 | 158.94 | 142.23 | 112.33 |
| HG4533-HT4938 |  | protease inhibitor 4 (kallistatin) | 18.98 | 0.00001 | 35.74 | 42.24 | 20.68 | 479.23 | 562.95 | 221.2 |
| J02943 | 2090 | corticosteroid binding globulin | 18.98 | 0.00087 | 57.44 | 39.79 | 44.72 | 880.54 | 924.99 | 144.24 |
| J03810 | 2099 | solute carrier family 2 (facilitated glucose transporter), member 2 | 21.99 | 0.00004 | 21.12 | 16.81 | 24.34 | 571.66 | 593.24 | 118.08 |
| J04056 | 2104 | carbonyl reductase 1 | 5.19 | 0.00001 | 9.77 | 22.83 | 29.45 | 145.33 | 139.19 | 73.11 |
| J05037 | 2116 | serine dehydratase | 16.24 | 0.00015 | 12.71 | 32.78 | 67.98 | 626.47 | 497.97 | 306.18 |
| J05158 | 2117 | carboxypeptidase N, polypeptide 2, 83kD | 8.52 | 0 | 2.27 | −7.78 | 21.43 | 209.63 | 218.19 | 81.01 |
| K02100 | 2123 | ornithine carbamoyltransferase | 10.24 | 0.00009 | 6.1 | 3.97 | 11.14 | 253.26 | 300.99 | 126.18 |
| K02402 | 2125 | coagulation factor IX (plasma thromboplastic component, Christmas disease, hemophilia B) | 28.81 | 0.00001 | 10.4 | 2.94 | 28.08 | 742.92 | 734.01 | 215.88 |
| L00972 | 2133 | cystathionine-beta-synthase glucan (1,4-alpha-), branching enzyme 1 (glycogen branching enzyme, Andersen | 7.19 | 0.00008 | 30.44 | 29.08 | 21.44 | 268.9 | 253.33 | 153.24 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| L07956 | 2148 | disease, glycogen storage disease type IV) | 5.6 | 0.00029 | 19.13 | 18.57 | 16.75 | 166.17 | 184.57 | 75.67 |
| L09717 | 2153 | lysosomal-associated membrane protein 2 | 4.06 | 0.00034 | 16.78 | 9.78 | 21.83 | 115.12 | 111.26 | 57.66 |
|  |  | murine leukemia viral (bmi-1) oncogene |  |  |  |  |  |  |  |  |
| L13689 | 2164 | homolog | #N/A | #N/A | 32.33 | 34.76 | 18.57 | 63.42 | 77.84 | 36.39 |
| L19871 | 2172 | activating transcription factor 3 | #N/A | #N/A | 72.2 | 31 | 78.72 | 98.22 | 85.66 | 61.41 |
| L27050 | 2186 | apolipoprotein F | 10.26 | 0.00026 | −23.8 | −20.7 | 14.43 | 258.1 | 252.65 | 124.08 |
| L27841 | 2187 | pericentriolar material 1 | #N/A | #N/A | 58.75 | 58.95 | 40.61 | 90.06 | 82.71 | 28.43 |
| L32140 | 2192 | afamin | 17.31 | 0.00003 | 9.44 | 16 | 10.75 | 426.89 | 464.97 | 221.11 |
| L32179 | 2193 | arylacetamide deacetylase (esterase) | 23.83 | 0 | 22.94 | 24.96 | 16.06 | 688.97 | 675.71 | 305.75 |
| L33799 | 2196 | procollagen C-endopeptidase enhancer | #N/A | #N/A | 87.45 | 73.5 | 89.14 | 230.54 | 248.1 | 130.08 |
|  |  | bile acid Coenzyme A: amino acid N- |  |  |  |  |  |  |  |  |
| L34081 | 2199 | acyltransferase (glycine N-cholyoyltransferase) | 11.96 | 0.00008 | 6.09 | 4.41 | 14.12 | 314.27 | 330.42 | 174.43 |
| L48516 | 2220 | paraoxonase 3 | 22.21 | 0.00004 | 36.05 | 28.85 | 37.25 | 896.92 | 896.69 | 337.05 |
| M10058 | 2230 | asialoglycoprotein receptor 1 | 23.96 | 0 | −47.64 | −42.75 | 75.52 | 591.6 | 603.68 | 188.25 |
| M11437 | 2238 | kininogen | 18.38 | 0.00006 | 20.84 | 10.7 | 36.84 | 535.53 | 529.53 | 186.97 |
| M11567 | 2239 | angiogenin, ribonuclease, RNase A family, 5 | 32.25 | 0.0001 | 2.5 | −18.19 | 58.03 | 1019.17 | 968.25 | 273.9 |
| M12625 | 2245 | lecithin-cholesterol acyltransferase | 4.55 | 0.01584 | 110.15 | 128.06 | 73.94 | 447.22 | 425.61 | 138.52 |
| M13143 | 2249 | kallikrein B plasma, (Fletcher factor) 1 | 10.39 | 0.00019 | 38.55 | 37.19 | 32.81 | 402.05 | 441.15 | 122.27 |
| M13699 | 2253 | ceruloplasmin (ferroxidase) | 15.85 | 0.00012 | 36.21 | 37.43 | 44.51 | 688.89 | 638.74 | 329.28 |
| M14091 | 2257 | thyroxin-binding globulin | 10.66 | 0.00024 | 1.76 | 2.84 | 9.9 | 269.26 | 284.66 | 119.28 |
| M15656 | 2268 | aldolase B, fructose-bisphosphate | 96.66 | 0 | −44.61 | −66.97 | 59.8 | 2911.78 | 2539.75 | 1883.04 |
|  |  | coagulation factor V (proaccelerin, labile |  |  |  |  |  |  |  |  |
| M16967 | 2275 | factor) | 5.56 | 0.00047 | 22.71 | 26.49 | 30.11 | 204.85 | 248.05 | 88.92 |
| M16973 | 2276 | complement component 8, beta polypeptide | 22.75 | 0.00001 | 20.03 | 23.43 | 31.9 | 686.99 | 714.82 | 203.16 |
| M17466 | 2279 | coagulation factor XII (Hageman factor) | 9.76 | 0.00285 | 94.21 | 63.47 | 93.18 | 706.11 | 724.27 | 261.46 |
|  |  | coagulation factor XI (plasma thromboplastin |  |  |  |  |  |  |  |  |
| M20218 | 2288 | antecedent) | 6.4 | 0.00004 | 38.74 | 45.83 | 14.62 | 247.85 | 259.47 | 69.46 |
| M20786 | 2290 | alpha-2-plasmin inhibitor | 16.95 | 0.00709 | 58.96 | −14.12 | 171 | 1074.45 | 1132.06 | 620.06 |
|  |  | alanyl (membrane) aminopeptidase |  |  |  |  |  |  |  |  |
| M22324 | 2295 | (aminopeptidase N, aminopeptidase M, microsomal aminopeptidase, CD13, p150) | #N/A | #N/A | 224.68 | 25.21 | 471.53 | 365.81 | 363.02 | 134.32 |
| M29194 | 2315 | lipase, hepatic | 12.18 | 0.00012 | 18.97 | 11.91 | 30.61 | 352.8 | 332.28 | 87.49 |
| M30269 | 2323 | nidogen (enactin) | 3.4 | 0.00026 | 19.81 | 26.36 | 14.57 | 96.8 | 94.16 | 42.52 |
| M63967 | 2378 | aldehyde dehydrogenase 5 | 4.04 | 0.00058 | 34.59 | 36.64 | 5.46 | 164.38 | 178.74 | 87.39 |
| M64174 | 2379 | Janus kinase 1 (a protein tyrosine kinase) | #N/A | #N/A | 10.42 | 10.81 | 15.82 | 59.51 | 59.38 | 27.77 |
| M64554 | 2380 | coagulation factor XIII, B polypeptide | 5.87 | 0.00011 | −4.73 | −4.91 | 7.92 | 137.26 | 136.8 | 72.05 |
|  |  | glycine dehydrogenase (decarboxylating; glycine decarboxylase, glycine cleavage |  |  |  |  |  |  |  |  |
| M64590 | 2381 | system protein P) | 6.41 | 0.00002 | 14.28 | 17.87 | 8.65 | 152.26 | 127.72 | 82.96 |
| M64929 | 2383 | protein phosphatase 2 (formerly 2A), regulatory subunit B (PR 52), alpha isoform | #N/A | #N/A | 64.63 | 38.82 | 95.31 | 106.38 | 88.13 | 67.95 |
|  |  | protein C inhibitor (plasminogen activator |  |  |  |  |  |  |  |  |
| M68516 | 2387 | inhibitor III) | 20.54 | 0 | −1.34 | −11.78 | 20.54 | 466.81 | 481.06 | 119.75 |
| M68840 | 2388 | monoamine oxidase A | 3.96 | 0.01396 | 42.09 | 28.9 | 45.52 | 182 | 201.64 | 94.09 |
| M69177 | 2391 | monoamine oxidase B | 11.64 | 0.00001 | 21.97 | 20.41 | 20.83 | 322.15 | 340.27 | 94 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| M74719 | 2395 | transcription factor 4 | #N/A | #N/A | 8.97 | 15.15 | 10.62 | 46.89 | 44.78 | 12.66 |
| M75106 | 2396 | carboxypeptidase B2 (plasma) | 40.63 | 0 | 19.77 | 30.19 | 22.24 | 1170.81 | 1124.59 | 329.77 |
| M76665 | 2397 | hydroxysteroid (11-beta) dehydrogenase 1 | 19.22 | 0.00004 | 33.41 | 17.51 | 23.86 | 628.97 | 670.88 | 196.22 |
| M83772 | 2408 | flavin containing monooxygenase 3 | 19.54 | 0 | 6.88 | −0.95 | 15.39 | 504.14 | 595.51 | 245.03 |
| | | SWI/SNF related, matrix associated, actin dependent regulator of chromatin, subfamily | | | | | | | | |
| M88163 | 2415 | a, member 1 | 3.37 | 0.00098 | 17.39 | 17.52 | 7.25 | 84.41 | 91.86 | 41.42 |
| M88338 | 2416 | serum constituent protein | #N/A | #N/A | 134.22 | 128.76 | 53.79 | 155.51 | 140.27 | 70.28 |
| M88468 | 2417 | mevalonate kinase (mevalonic aciduria) | #N/A | #N/A | 89.85 | 108.13 | 54.23 | 214.81 | 260.33 | 86.76 |
| | | methylmalonate-semialdehyde | | | | | | | | |
| M93405 | 2423 | dehydrogenase | 23.06 | 0 | 16.51 | 27.77 | 20.66 | 679.66 | 734.58 | 307.25 |
| M94065 | 2424 | dihydroorotate dehydrogenase | 6.47 | 0.00013 | 30.26 | 20.14 | 17.64 | 202.13 | 183.44 | 86.43 |
| | | electron-transferring-flavoprotein | | | | | | | | |
| S69232 | 3026 | dehydrogenase | 4.9 | 0.00017 | 2.73 | 4.9 | 4.29 | 113.33 | 103.27 | 60.93 |
| S70004 | 3028 | glycogen synthase 2 (liver) | 9.96 | 0.00001 | −0.03 | −4.28 | 11.42 | 225.1 | 212.32 | 102.76 |
| S82240 | 3038 | ras homolog gene family, member E | #N/A | #N/A | 19.9 | 6.78 | 30.8 | 75.14 | 74.07 | 40.43 |
| U00115 | 3271 | B-cell CLL/lymphoma 6 (zinc finger protein 51) | 5.18 | 0.00045 | 16.17 | 10.31 | 26.94 | 132.13 | 133.88 | 32.06 |
| U01120 | 3273 | glucose-6-phosphatase, catalytic (glycogen storage disease type I, von Gierke disease) | 13.41 | 0.00147 | 83.05 | 45.5 | 91.8 | 878.33 | 693.43 | 495.6 |
| U03056 | 3279 | hyaluronoglucosaminidase 1 | 6.64 | 0 | 12.68 | 11.77 | 4.73 | 139.32 | 137.21 | 43.97 |
| | | complement component 8, gamma | | | | | | | | |
| U08198 | 3291 | polypeptide | 19.71 | 0 | −29.27 | −38.32 | 47.54 | 544.28 | 630.51 | 234.87 |
| U11313 | 3296 | sterol carrier protein 2 | 5.44 | 0.00187 | 17.39 | 0.82 | 35.86 | 181.8 | 228.15 | 99.25 |
| U12778 | 3300 | acyl-Coenzyme A dehydrogenase, short/branched chain | 5.68 | 0.00116 | 5.23 | 6.16 | 7.33 | 147.06 | 158.14 | 91.5 |
| | | sulfotransferase family 2A, dehydroepiandrosterone (DHEA) -preferring, | | | | | | | | |
| U13061 | 3301 | member 1 | 11.32 | 0.00048 | 9.86 | 7.49 | 19.46 | 369.12 | 431.45 | 213.83 |
| U15174 | 3309 | BCL2/adenovirus E1B 19kD-interacting protein 3 | #N/A | #N/A | 41.72 | 11.86 | 49.01 | 129.19 | 138.02 | 68.72 |
| U15932 | 3310 | dual specificity phosphatase 5 | #N/A | #N/A | 47.94 | 27.05 | 47.87 | 86.73 | 86.97 | 38.45 |
| U17989 | 3315 | nuclear autoantigen | #N/A | 0.02825 | 14.21 | 12.72 | 6.13 | 44.22 | 41.28 | 19.09 |
| U19523 | 3319 | GTP cyclohydrolase 1 (dopa-responsive dystonia) | 5.25 | 0.00029 | 12.84 | 12.26 | 15.75 | 136.86 | 142.71 | 66.64 |
| U20530 | 3321 | secreted phosphoprotein 2, 24kD | 16.93 | 0 | 12.63 | 11.54 | 9.93 | 383.92 | 421.24 | 128.02 |
| | | nuclear receptor subfamily 1, group H, | | | | | | | | |
| U22662 | 3328 | member 3 | #N/A | #N/A | 5.71 | 14.46 | 20.18 | 63.21 | 58.72 | 37.5 |
| U31342 | 3343 | nucleobindin 1 | #N/A | #N/A | 77.59 | 66.2 | 40.03 | 183.59 | 197.29 | 58.86 |
| U32989 | 3347 | tryptophan 2,3-dioxygenase | 10.07 | 0.02825 | 166.12 | 22.7 | 333.99 | 527.61 | 473.11 | 268.8 |
| | | cytochrome P450, subfamily III (arachidonic | | | | | | | | |
| U37143 | 3353 | acid epoxygenase) polypeptide 2 | #N/A | #N/A | 33.79 | 28.24 | 31.46 | 116.06 | 131.46 | 48.68 |
| U37547 | 3354 | apoptosis inhibitor 1 | #N/A | #N/A | 29.52 | 19.51 | 48.74 | 93.6 | 112.45 | 52.27 |
| | | aldehyde dehydrogenase 10 (fatty aldehyde | | | | | | | | |
| U46689 | 3365 | dehydrogenase) | 3.5 | 0.01292 | 31.22 | 25.36 | 49.19 | 124.41 | 136.16 | 53.23 |
| | | protein phosphatase 1, regulatory (inhibitor) | | | | | | | | |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| U48707 | 3370 | subunit 1A | 14.22 | 0 | -1.33 | -1.45 | 20.92 | 319.97 | 310.24 | 125.51 |
| U49082 | 3372 | transporter protein | 9.17 | 0.00088 | 71.87 | 46.71 | 56.13 | 563.34 | 515.31 | 179.82 |
| U49248 | 3373 | ATP-binding cassette, sub-family C (CFTR/MRP), member 2 | 7.06 | 0.00067 | 30.01 | 26.03 | 36.14 | 231.96 | 249.25 | 91.2 |
| U50929 | 3379 | betaine-homocysteine methyltransferase | 36.91 | 0 | 8.63 | 2.82 | 20.35 | 898.57 | 865.9 | 313.61 |
| U57094 | 3393 | RAB27A, member RAS oncogene family | #N/A | #N/A | 30.85 | 31.58 | 23.86 | 93.06 | 93.79 | 50.75 |
| U59423 | 3398 | MAD (mothers against decapentaplegic, Drosophila) homolog 1 | #N/A | #N/A | 17.46 | 16.81 | 10.17 | 60.5 | 51.09 | 37.25 |
| U68233 | 3411 | nuclear receptor subfamily 1, group H, member 4 | 6.76 | 0.00022 | 19.94 | 9.8 | 29.99 | 198.25 | 233.6 | 83.71 |
| U69141 | 3413 | glutaryl-Coenzyme A dehydrogenase | 3.06 | 0.00053 | 35.13 | 27.91 | 13.89 | 108.36 | 119.26 | 34.82 |
| U72515 | 3415 | putative protein similar to nessy (Drosophila) | #N/A | #N/A | 45.44 | 58.93 | 45.12 | 137.35 | 138.01 | 55.38 |
| U73514 | 3418 | hydroxyacyl-Coenzyme A dehydrogenase, type II | 3.79 | 0.01392 | 9.85 | -22.7 | 56.91 | 159.74 | 161.9 | 127.8 |
| U77396 | 3425 | LPS-induced TNF-alpha factor | 4.47 | 0.00108 | 30.53 | 33.74 | 31.54 | 169.83 | 141.36 | 87.43 |
| U77594 | 3427 | retinoic acid receptor responder (tazarotene induced)2 | 11.95 | 0.00527 | 94.59 | 122.86 | 71.01 | 838.98 | 864.02 | 313.87 |
| U79716 | 3436 | reelin | 3.51 | 0.00053 | 14.44 | 9.15 | 15.58 | 90.6 | 101.49 | 36.51 |
| U81607 | 3439 | A kinase (PRKA) anchor protein (gravin) 12 | #N/A | #N/A | 18.75 | 8.46 | 50.91 | 82.7 | 78.31 | 62.79 |
| U83461 | 3443 | solute carrier family 31 (copper transporters), member 2 | #N/A | #N/A | 24.64 | 21.28 | 13.16 | 51.79 | 48.53 | 20.85 |
| U85193 | 3446 | nuclear factor I/B | #N/A | #N/A | 21.84 | 23.61 | 4.44 | 72.71 | 68.69 | 32.02 |
| U90544 | 3453 | solute carrier family 17 (sodium phosphate), member 2 | 6.42 | 0.00023 | -3.14 | -5.18 | 19.12 | 157.41 | 168.92 | 63.8 |
| X02750 | 3670 | protein C (inactivator of coagulation factors Va and VIIIa) | 7.04 | 0.00079 | 55.79 | 52.95 | 30.08 | 373.11 | 367.46 | 95.74 |
| X06562 | 3683 | growth hormone receptor | 10.87 | 0.00001 | 10.46 | 6.89 | 15.53 | 291.31 | 314.9 | 160.29 |
| X07732 | 3690 | hepsin (transmembrane protease, serine 1) | 28.21 | 0 | -8.34 | -12 | 39.24 | 678.15 | 672.42 | 183.61 |
| X07767 | 3691 | protein kinase, cAMP-dependent, catalytic, alpha | 5.94 | 0.00028 | 16.15 | 19.43 | 11.48 | 152.58 | 160.88 | 73.73 |
| X12662 | 3694 | arginase, liver | 20.59 | 0 | 11.33 | 10.15 | 12.81 | 486.71 | 479.11 | 199.71 |
| X13227 | 3695 | D-amino-acid oxidase | 4.81 | 0.0002 | 25.1 | 33.95 | 26.2 | 166.22 | 147.21 | 77.49 |
| X14813 | 3702 | acetyl-Coenzyme A acyltransferase 1 (peroxisomal 3-oxoacyl-Coenzyme A thiolase) | 11.61 | 0.0002 | 59.4 | 71.51 | 42.45 | 712.58 | 704.45 | 258.91 |
| X15393 | 3704 | motilin | #N/A | #N/A | 70.16 | 55.83 | 27.07 | 113.93 | 117.96 | 26.14 |
| X16663 | 3711 | hematopoietic cell-specific Lyn substrate 1 | #N/A | #N/A | 48.32 | 28.69 | 56.44 | 81.51 | 83.53 | 33.75 |
| X17094 | 3714 | paired basic amino acid cleaving enzyme (furin, membrane associated receptor protein) | 8.5 | 0 | -1.85 | 7.01 | 25.41 | 190.11 | 216.35 | 74.11 |
| X53414 | 3725 | alanine-glyoxylate aminotransferase (oxalosis I; hyperoxaluria I; glycolicaciduria; serine-pyruvate aminotransferase) | 13.87 | 0.00003 | 138.92 | 110.29 | 90.59 | 1856.57 | 1888.79 | 846.06 |
| X54380 | 3727 | pregnancy-zone protein | 8.44 | 0.00059 | 4.93 | 3.19 | 19.26 | 274.41 | 255.4 | 203.47 |
| X56411 | 3734 | alcohol dehydrogenase 4 (class II), pi polypeptide | 25.14 | 0.00144 | 55.53 | 11.29 | 102.45 | 991.98 | 943.64 | 448.31 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| X57025 | 3739 | insulin-like growth factor 1 (somatomedin C) | 4.72 | 0.00087 | 5.88 | 10.95 | 10.22 | 120.82 | 100.54 | 85.16 |
| X63359 | 3756 | UDP glycosyltransferase 2 family, polypeptide B10 | 13.66 | 0.00051 | 55.28 | 48.57 | 41.25 | 669.93 | 732.6 | 161.42 |
| X63417 | 3757 | c-myc promoter-binding protein | #N/A | #N/A | 28.85 | 27.75 | 24.56 | 68.08 | 56.34 | 33.18 |
| X76105 | 3791 | death-associated protein | 3.02 | 0.00944 | 30.12 | 33.72 | 31.36 | 108.68 | 118.36 | 56.76 |
| X78992 | 3799 | butyrate response factor 2 (EGF-response factor 2) | 4.69 | 0.01995 | 64.86 | 31.76 | 66.31 | 318.26 | 336.95 | 207.43 |
| X79981 | 3803 | cadherin 5, VE-cadherin (vascular epithelium) | #N/A | #N/A | 45.01 | 41.07 | 11.65 | 80.92 | 80.1 | 8.57 |
| X90999 | 3817 | hydroxyacyl glutathione hydrolase; glyoxalase 2 | 5.27 | 0.00047 | 16.15 | 26.83 | 26.47 | 170.37 | 179.54 | 76.98 |
| X91148 | 3818 | microsomal triglyceride transfer protein (large polypeptide, 88kD) | 5.91 | 0.00045 | 15.37 | 3.85 | 31.49 | 173.77 | 189.11 | 83.82 |
| X92396 | 3820 | synaptobrevin-like 1 | #N/A | #N/A | 40.87 | 17.73 | 57.17 | 67.49 | 61.23 | 31.24 |
| X95190 | 3829 | acyl-Coenzyme A oxidase 2, branched chain | 12.81 | 0 | −80.53 | −76.73 | 37.81 | 285.88 | 349.39 | 119.31 |
| X97160 | 3835 | transcription factor binding to IGHM enhancer 3 | #N/A | #N/A | 61.31 | 49.54 | 30.41 | 75.26 | 66.36 | 29.46 |
| Z28339 | 3872 | aldo-keto reductase family 1, member D1 (delta 4-3-ketosteriod-5-beta-reductase) | 24.66 | 0 | 3.67 | 3.48 | 5.1 | 527.72 | 552.17 | 156.66 |
| Z47553 | 3936 | flavin containing monooxygenase 5 | 6.17 | 0.0011 | 4.86 | 1.26 | 8.96 | 141.98 | 165.57 | 59.33 |
| Z48054 | 3938 | peroxisome receptor 1 | #N/A | #N/A | 46.89 | 51.87 | 23.55 | 78.16 | 80.88 | 26.87 |
| Z48633 | 3941 | EST | #N/A | #N/A | −5.51 | −6.39 | 13.15 | 36.84 | 40.63 | 26.33 |
| Z49269 | 3942 | small inducible cytokine subfamily A (Cys-Cys), member 14 | 18.46 | 0.00001 | 1.88 | −25.63 | 41.94 | 526.13 | 532.29 | 166.67 |
| Z49878 | 3943 | guanidinoacetate N-methyltransferase | 13.96 | 0.00021 | 44.63 | 45.34 | 41.76 | 615.57 | 659.09 | 196.31 |
| K02766 | 2126 | complement component 9 | 21.24 | 0 | 23.15 | 14.02 | 21.18 | 652.66 | 656.14 | 320.1 |
| L04751 | 2138 | cytochrome P450, subfamily IVA, polypeptide 11 | 36.79 | 0.00004 | 32.39 | 23.29 | 32.64 | 1164.28 | 1183.4 | 334.08 |
| M24283 | 2303 | intercellular adhesion molecule 1 (CD54), human rhinovirus receptor | 3.19 | 0.04985 | 77.88 | 34.05 | 69.45 | 207.07 | 183.74 | 121.4 |
| M61853 | 2369 | cytochrome P450, subfamily IIC (mephenytoin 4-hydroxylase), polypeptide 18 | 7.82 | 0.00024 | 12.17 | 12.44 | 4.36 | 191.94 | 204.27 | 91.68 |
| S77410 | 3034 | angiotensin receptor 1 | 10.4 | 0 | 18.77 | 17.34 | 10.85 | 266.59 | 284.37 | 98.14 |
| U20938 | 3323 | dihydropyrimidine dehydrogenase | 3.92 | 0.00053 | 6.66 | 6.08 | 7.12 | 90.66 | 97.02 | 44.64 |
| U60061 | 3399 | fasciculation and elongation protein zeta 2 (zygin II) | #N/A | #N/A | 61.44 | 29.18 | 68.3 | 55.02 | 66.29 | 38.2 |
| X15422 | 3705 | mannose-binding lectin (protein C) 2, soluble (opsonic defect) | 8.29 | 0.00015 | 2.28 | 2.69 | 7.25 | 208.25 | 221.14 | 123.22 |
| X16323 | 3708 | hepatocyte growth factor (hepapoietin A; scatter factor) | #N/A | #N/A | 10.65 | 6.56 | 6.59 | 32.58 | 30.52 | 9.66 |
| Y00097 | 3841 | annexin A6 | 3.4 | 0.00233 | 19.43 | 16.39 | 33.67 | 105.39 | 104.75 | 39.99 |
| M15465 | 2266 | pyruvate kinase, liver and RBC | 6.1 | 0.00069 | 3.06 | 3.32 | 11.38 | 158.56 | 132.57 | 102.11 |
| D13814 | 1611 | angiotensin receptor 1, angiotensin receptor 1B | 3.12 | 0.00101 | 13.86 | 10.01 | 12.82 | 79.69 | 75.71 | 45.03 |
| HG2383-HT4824 | | cystathionine-beta-synthase | 13.57 | 0.00035 | −0.01 | 2.09 | 10.74 | 377.07 | 375.12 | 210.67 |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| HG2730-HT2827 | | fibrinogen; A alpha polypeptide | 25.1 | 0 | 17.62 | 12.16 | 24.49 | 720.93 | 681.36 | 269.11 |
| HG2743-HT2846 | | caldesmon 1 | 3.33 | 0.00135 | 27.49 | 25.6 | 21.89 | 103.56 | 92.79 | 35.98 |
| M83216 | 2406 | caldesmon 1 | 4.27 | 0.00037 | 7.89 | 2.98 | 12.17 | 105.21 | 109.38 | 55.62 |
| J03242 | 2092 | insulin-like growth factor 2 (somatomedin A) | 4.01 | 0.00042 | 40.37 | 45.32 | 15.53 | 179.86 | 172.23 | 104.64 |
| J04093 | 2106 | UDP glycosyltransferase 1 | 18.92 | 0 | 8.62 | 8.7 | 12.9 | 462.51 | 511 | 215.46 |
| M13232 | 2251 | coagulation factor VII (serum prothrombin conversion accelerator) | 5.9 | 0.00014 | 43.46 | 42.59 | 18.46 | 248.65 | 275.82 | 70.94 |
| Y00339 | 3844 | carbonic anhydrase II | 6.89 | 0 | 6.23 | -1.39 | 18.22 | 168.76 | 178.44 | 69.52 |
| X02176 | 3669 | complement component 9 | 9.61 | 0.00004 | 47.28 | 46.34 | 28.54 | 507.56 | 507.21 | 261.45 |
| U37055 | 3352 | macrophage stimulating 1 (hepatocyte growth factor-like), macrophage stimulating, pseudogene 9 | 18.28 | 0 | -7.37 | -38.2 | 47.48 | 549.49 | 626.51 | 217.69 |
| X65727 | 3765 | glutathione S-transferase A2, glutathione S-transferase A3 | 73.64 | 0 | 21.03 | 17.39 | 15.18 | 2162.22 | 2183.18 | 1435.52 |
| U80226 | 3438 | 4-aminobutyrate aminotransferase | #N/A | #N/A | 39.69 | 51.46 | 20.33 | 86.94 | 91.76 | 24.15 |
| U19495 | 3318 | stromal cell-derived factor 1 | 4.59 | 0.00011 | 7.17 | 5.76 | 5.65 | 103.81 | 114.61 | 50.36 |
| U08006 | 3289 | complement component 8, alpha polypeptide | 16 | 0.00111 | 47.06 | 31.92 | 47.52 | 633.01 | 661.72 | 102.98 |
| M23234 | 2299 | ATP-binding cassette, sub-family B (MDR/TAP), member 4 | 10.05 | 0 | -4.37 | -11.49 | 29.05 | 255.03 | 242.93 | 112.08 |
| M30257 | 2322 | vascular cell adhesion molecule 1 | 3.11 | 0.00064 | 17.33 | 13.46 | 10.06 | 78.1 | 82.04 | 35.74 |
| M86873 | 2413 | plasminogen, plasminogen-like | 17.54 | 0 | -3.92 | -8.08 | 6.71 | 410.11 | 403.69 | 218.51 |
| M65134 | 2385 | complement component 5 | 12.01 | 0.00012 | 2.31 | 3.66 | 7.43 | 303.27 | 337.95 | 151.33 |
| X65962 | 3766 | cytochrome P450, subfamily IIC (mephenytoin 4-hydroxylase) | 5.47 | 0.00014 | 36.73 | 31.48 | 11.66 | 247.79 | 149.39 | 208.59 |
| M98399 | 2436 | CD36 antigen (collagen type I receptor, thrombospondin receptor) | #N/A | #N/A | 4.71 | 4.58 | 5.51 | 47.65 | 38.28 | 35.2 |
| X86401 | 3812 | glycine amidinotransferase (L-arginine: glycine amidinotransferase) | 22.7 | 0 | 19.17 | 9.16 | 19.13 | 646 | 721.34 | 274.64 |
| U08854 | 3292 | UDP glycosyltransferase 2 family, polypeptide B15 | 7.38 | 0.00005 | 10.72 | 6.45 | 10.71 | 181.08 | 184.97 | 91.81 |
| U51010 | 3380 | nicotinamide N-methyltransferase | 27.79 | 0.00366 | 105.25 | 43.72 | 204.23 | 1589.66 | 1590.62 | 536.04 |
| X07619 | 3689 | cytochrome P450, subfamily IID (debrisoquine, sparteine, etc., -metabolising), polypeptide 7a (pseudogene) | 4.96 | 0.00004 | 32.26 | 33.56 | 10.88 | 177.56 | 206.15 | 77.69 |
| X64877 | 3763 | H factor (complement)-like 3 | 14.6 | 0 | 14.6 | 7.51 | 21.01 | 387.8 | 402.95 | 151.23 |
| X64877 | 3763 | H factor (complement)-like 3 | 12.33 | 0 | 6.14 | 8.26 | 14.25 | 262.65 | 268.29 | 84.84 |
| X98337 | 3837 | complement factor H related 3, complement factor H related 4 | 13.5 | 0.00001 | 18.76 | 22.2 | 33.33 | 411.51 | 375.08 | 169.37 |
| X94563 | 3828 | EST | 3.52 | 0.00928 | 76.79 | 66.4 | 52.64 | 274.91 | 244.92 | 177.63 |
| D90042 | 1767 | N-acetyltransferase 2 (arylamine N-acetyltransferase) | 7.06 | 0 | 5.13 | 18.92 | 32.5 | 167.38 | 176.16 | 66.7 |
| M10943 | 2234 | metallothionein 1F (functional) | 3.88 | 0 | 53.15 | 52.73 | 8.81 | 217.65 | 186.71 | 86.73 |
| | | aldo-keto reductase family 1, member C4 (chlordecone reductase; 3-alpha hydroxysteroid dehydrogenase, type I; | | | | | | | | |

TABLE 9B-continued

Genes and ESTs expressed only in Normal2 vs Metastatic Liver Tumor

| Fragment Name | SEQ ID: | Known Gene Name | fold change in metas | p value | metastatic: Mean | metastatic: Median | metastatic: Std Dev | normal set 2: Mean | normal set 2: Median | normal set 2: Std Dev |
|---|---|---|---|---|---|---|---|---|---|---|
| S68287 | 3024 | dihydrodiol dehydrogenase 4) | 24.11 | 0 | 6.23 | 6.37 | 9.75 | 510.59 | 569.32 | 165.14 |
| U02388 | 3277 | cytochrome P450, subfamily IVF, polypeptide 2 | 9.38 | 0.00001 | −4.93 | −3.43 | 18.14 | 207.48 | 207.15 | 90.12 |
| U05861 | 3284 | aldo-keto reductase family 1, member C1 (dihydrodiol dehydrogenase 1; 20-alpha (3-alpha)-hydroxysteroid dehydrogenase) | 23.22 | 0.00002 | 47.98 | 44.41 | 21.91 | 1070.69 | 962.74 | 359.01 |
| L11931 | 2159 | serine hydroxymethyltransferase 1 (soluble) | 7.27 | 0.00041 | −18.81 | −31.65 | 26.43 | 188.25 | 181.11 | 114.89 |
| L32961 | 2194 | 4-aminobutyrate amino transferase | #N/A | #N/A | 15.64 | 7.44 | 15.63 | 76.44 | 79.62 | 26.55 |
| M16594 | 2272 | glutathione S-transferase A2 | 73.21 | 0 | −3.62 | −9.74 | 18.15 | 1602.11 | 1787.28 | 655.41 |
| L00389 | 2132 | cytochrome P450, subfamily I (aromatic compound-inducible), polypeptide 2 | #N/A | #N/A | 69.38 | 86.39 | 64.81 | 222.59 | 184.81 | 121.16 |
| M33317 | 2338 | cytochrome P450, subfamily IIA (phenobarbital-inducible), polypeptide 7 | 32.63 | 0 | 44.53 | 35.06 | 29.77 | 1613.89 | 1437.34 | 1086.43 |
| U22029 | 3326 | cytochrome P450, subfamily IIA (phenobarbital-inducible), polypeptide 7 | 71.98 | 0 | 5.05 | 10.11 | 21.51 | 1968.7 | 1339.04 | 1937.45 |
| X13930 | 3697 | cytochrome P450, subfamily IIA (phenobarbital-inducible, polypeptide 6 | 38.52 | 0 | 52.66 | 64.02 | 31.42 | 2408.66 | 1948.18 | 1843.46 |

SEQUENCE LISTING (3950 sequences)

SEQ ID NO: 1 - DNA, 282 bp, Homo sapiens
  Genbank Accession No. AA001409
tttttttttttttcttctgactaggtatttattaagttctaaaaccttgaataactgctattttaaaaattcacactaaaagaaaactagaaatgttaacatcttttacagagggcagtaagtggccttttttttttttttaaattataattgcctaggagaaaggtgagctaatctctttggaagtgtcatcagctggtgaacttcatcttggtctccactttatgtctttcactccatgaaaatgtcttttcaaagcagtgttatccgcccatggtgagt

SEQ ID NO: 2 - DNA, 507 bp, Homo sapiens
  Genbank Accession No. AA001504
  unsure (1)..(507): n = a or c or g or t
ccaagccaaactatatctagctttattaaagttactttccataaacaatcagggtatttcaggcaggacatgggcagataatcgttaacggtgtacaacaactttcaaactcccttcttcaatggactagcaaaatcggaaagccactataaaacccagtgaggtcttcatnttatgccctgaacagggagagtttagagtgagggttgacatttcaactttagcatattgtttaacagcttttcatgaactgaccctgacttccaggaaatgaaataaaaatggcagaatttatctgaaaatctgaaaatccacaatctaagaaatnggaaactctactctttttcggggggctccatctcantggcaccactgggaaattnttggttngcctggacacactggtaaccaattactgggagggtcaggggcccancaggagttttgggttttaangggagttaaagtcnaatgtttggaaggatgaccangggtaaaagagggacc

SEQ ID NO: 3 - DNA, 244 bp, Homo sapiens
  Genbank Accession No. AA001603
  unsure (1)..(244): n = a or c or g or t
ttgagtgaaagtattttatttggggagtgtgaataacacagcaaggaaagtggacgcaacccagggaaagggtgacatcctgccacgtgtgtgccacaagaccagcaacaggagcaggcgaccagagcttaaccccatgggangacactgggaaaggaggcaaaacacacacttcagaattattccactccagctgcagagagctccggtggtatttttccaccaggacctcagctacacatgc

SEQ ID NO: 4 - DNA, 421 bp, Homo sapiens
  Genbank Accession No. AA001604
cttatgaataatgttagaaatggaacatgatgttttaaatgtatacataaaccttccaattaattatcaggtgatccagtagtagacctgtgacctctgaaggctcctgcttctcatcccttcccttctgctgtgatttgttgtcttccctctgctcattccccttgtgtctgtttcttccatcctctccccatgctccctctgttgtcatttccccttactctccactgcacccagcctctgttcataatttttactgcaattccgatgattgaattataaactggaagggagcagggatattgatcttcatgtagttggacatgtactagactcacggagaacaaggactgggttgtaggcacaatgctgtgtgggttttgggtaaatctaactcacactcaacttgattttgttttcc

SEQ ID NO: 5 - DNA, 387 bp, Homo sapiens
  Genbank Accession No. AA001902
  unsure (1)..(387): n = a or c or g or t
atagctgcataaaacaaatgggctagattttacttcatatttcaaaattcagagaaagagagtagtattaaaagacataagccaaaaatagatcattgcagactgagtacaaagaaccattctatttcttctcttaaaaaattaaaatttcaaattaagtaccaatgaccaaataagtaacaaacacattcagaaacatactatatgtctacaaagaatacttcaaaatgtgcctccaaacttcaggcacataattccaatttttattgaatgtagagattttatgaaaacaantccaangctgtcccatcatggaacagccctctaccatttgggttattttaagactgttccaattacttacatgggcagaatacataccactat

SEQ ID NO: 6 - DNA, 202 bp, Homo sapiens
  Genbank Accession No. AA001903
  unsure (1)..(202): n = a or c or g or t
tgaagtttaataatatattttatttaacccaatgtacactattaaaaaataacccaatattttcaacatttaatcaatgtaaaaatggagatattacatgtgtgtatatataatacataanattaataatataggaataatgaataatatatatttatatggtaaaatatggaatttttataccnaggttttaaaancctgg

SEQ ID NO: 7 - DNA, 455 bp, Homo sapiens
  Genbank Accession No. AA004231
  unsure (1)..(455): n = a or c or g or t
atgagcctgcactcagagtggagtgttggctggaacatgcacacctgcaactgagggttctaaagtcataggttaggcccttctcccgggtaggtctggacatgcacaccaggagtgacgttcccaactctagataactatgtgctaggctctgggctaagtgctttacataatgttgctcaggacaacaggacaaccctatgatttaggtgcacccattctacttggagggattgaggcttagatgttaacgtaacttgcctaaggttagagccattaagtttcaggagtctgatctgaactccgtctacacctgcactgtccagtgtggtaggtcacctagtngacatggtgaccattttgaangttgaattaaaataagaacttcagttcccttagttgttgccagcttcatttcaattgctcagcagctggtctgtggctagtttggttgg

SEQ ID NO: 8 - DNA, 457 bp, Homo sapiens
  Genbank Accession No. AA004521
gaacttctcttggtatttataaatctacggccatggtctatgtgcatgttacaggtagaaaagccatatggggcactccttttggttgctcaggccttgattgcctgtcatccaggtcccttggtctgagaagtctatgcggtcacctcagagccgctaagcaccttcagtgggcccatcccattggcggcgtactcctgctggagccgggcacggtaatagaagaggtaggaaggcaacaggaatcccaggagtgagaatagcaggaggcccagattcacctttagggcaaggagagagaaacagagtcaagtaggtagtcatctgcccttagcctcccacagggagaagaaaggcggccatttttctccaggtcctggagccagaataaatacagctagtacttattatgtgtagtcattgttccaccagtatctcacttaatgttcagcaattc

SEQ ID NO: 9 - DNA, 447 bp, Homo sapiens
  Genbank Accession No. AA004669
  unsure (1)..(447): n = a or c or g or t
aacactagaaagcacttttattttttcaaaacacaaatataaatgctatgtcatgatattgttaataattttacaggtacctcatcatgttacccattcagatatgtgcttaaggtaggtgttcctacaggatcttgggttggatngttccgtttgatttnattttaaaaataataaatcacaaaactaaaacgtttgagcaaggtcacttaaccctctccccaggtggttagttattattaccatcatcatcctcctcaacatcattattacttttcagctacatgtttaaaagaggagatctttaaatatgtcagcttaactgggggaaaatgtgtcccctgggcancaaggtnggttttccagaatgaaaaagccccatctttcacaaagagcttttggtcctctggcgtttatttttaaagtggcggaccctgggtggggagg

SEQ ID NO: 10 - DNA, 427 bp, Homo sapiens
  Genbank Accession No. AA004707
  unsure (1)..(427): n = a or c or g or t
ttcccaaacgaaaataaaactttcatttgccaagggaacaccacagcagctcctgccctgtactgagctctccaaagactgggcaggcaaagtccctctggccccctctggaagtggaaagtgctcgccctggaggacagcaacagagccaaggtgaggtcctgctcaaaggtgggcagggggctgcgctgactcctttcggcccttgccagcgatgggccggcctcgctcctcccagatggtgaggccatcgcaagagcagatctgcttggggttctggaaaaggccagcggagttgncaattgatgccacaggcaacctctccccggagttccctgtgatcttggataagggatggcctccccggcccaggtcatcttctccctcatcaataatcaggctgcggccaatcacatcccacaccttc

SEQ ID NO: 11 - DNA, 431 bp, Homo sapiens
  Genbank Accession No. AA004905
  unsure (1)..(431): n = a or c or g or t
aggagaatgttttaatgcttaagaggcaggatcaagtgaagaggttacagaaatcagtgtctctggctgggcagtcaagagagcgggctcaaattctgtgactcacttctctgtgtctcggttggaaatgaatgggtatcctggttcccaccttcccacacgctgtgatacttcaaactccttgggtgaagggcctcttctcagcccaagatcttgattgtgaacattaacaaagagaacagtcatcctccacagaagataactcattaatgacatttgattcagtgaataaatatatcatttaaaaaaatattgtagggggatcatgaaagtagtggaggtaattacaatcaggagagattggttattaaaattngagcaaagtcccaactctcaccagatgacaattatgcatcctgctagatgccccn

SEQ ID NO: 12 - DNA, 402 bp, Homo sapiens
  Genbank Accession No. AA005202
tgaaagtggacccagtttttatgtagataatgaacatcatgatggccttagagctggcttcattcaaatgcttcttaattcaaatgcatcacagcagattgcaacccttacggatacaggtggctgtaattcataaacaccttcaaggctgtttctgaaacccactgaattttctctggacgtaatgggggtggagagaatatgacttgctggatgaacagggcttcctttgatttctcttaagtctgccttattgcatttcaaagtgtcgggggccaccctcagctttcaggaagtgggagccaaggcagcctgacctgggacacactggtgatggttttataaagtgcttctatgtctcatgtcatgtgtcaccagatggtgtggcacaagggacttcca

SEQ ID NO: 13 - DNA, 349 bp, Homo sapiens
  Genbank Accession No. AA005262
  unsure (1)..(349): n = a or c or g or t
cattttaaaagtagtttagagatagcatcaggtaggccaaacaactgtactgggcccctgtagagattagggtttggtctattaaaaaaaatctttgcttgctggaactgcaagcttggcttccctgcaagctcaataggttctggagctcatttaccatgtcgctcgctggatcccagaaagttgcccatggtcagctaagtgacggaagactatacgactaagcctccagcgccgcttcacaccacgcggacgggacggtcataacacacccgatttctggattctaacanggacangctaatccccgggggatggggcaagcaatttcttcattcaaggccanatt

SEQ ID NO: 14 - DNA, 409 bp, Homo sapiens
  Genbank Accession No. AA005358
  unsure (1)..(409): n = a or c or g or t
tttggcttgaacaataaaaagagtttattggttcaccatcaccgagaggttgaaaggtggggaggcttcgggtgtggtgcagtcagggcttcaactccgggtctatgtgattaccctggccatgtccttcttctgtaggttagcaccttccttgggctggtttcttccagggtcacaggatggctacctcctgagcaggagggaattctgcctgaatcactggacaatggttggaggatggacgttgagaagtagaagtaatgtctctgatccttggcagctgagtggcagtggcaaatcccttagcttctcttcacatcattttccaaatctngtaatatggctngtacaaattcttagnccaaactccttagcatggncgttggagtcccttncgcatctgggattc

SEQ ID NO: 15 - DNA, 287 bp, Homo sapiens
  Genbank Accession No. AA007158
tttcacaaatgtcaattttattgacactagtgcacaactaaatacaataattgcaaaggaagtggaacgtgtcaaacagaaatggtgacaatgagttagaactgcagttgtttcaaggtactacactattatttaaaaaaaaaactcacaaaaagaaaaatgttatcactacaagtaggaattagaagagagaaatcctggcagtctgtctagaggttaaaacatttcatgcatttgtgagttgctgttggagagtttgttttttatttgtccaccgtaatctggca

SEQ ID NO: 16 - DNA, 295 bp, Homo sapiens
  Genbank Accession No. AA007160
tttggaagccatagaatttattcgaatttgcagaagcatgagataatgtaccacaaaagagtttgattttacaacataaagtatggtaggaagtggtcaatgtacacagtgttgtcagcaaaaaggggaggcagggcagtttcacattttttgaaaggtggtggacgacaactacacttgtccttaaagtaaaataaaagcaggagagacccagcagagaccaacctgatttgcagttagcatcagaatctaaatctagtatcacaactttaagaaactaaaagaaaactattag

SEQ ID NO: 17 - DNA, 465 bp, Homo sapiens
  Genbank Accession No. AA007395
gccaatctagttttatttattatctcttcattccccactttcaacttcccagaactaattttaaacaatttctaaagatgatatgattctattcataaacactagttattattattatttaacatagggaatattcatatatataacaggtacaaagtctataatatttaaagctcttttatgttcccatattaaatgtaaatatttgtttaaacgcatggctttccttggttcatcaaatcaggtaataaattaaccaggcaggttcacattcaatcagatagtattccgaattgctcctggcatcttcaaaagatgaggattgttcggatgctttttccttggttcattaggtcaaatgcctcactgattttgtcaaaaggcagggtatgggtcaccagtgcatccagattgaatttcttattcttatagtcagtgaccagctttgggatagaatctacactt

SEQ ID NO: 18 - DNA, 378 bp, Homo sapiens
  Genbank Accession No. AA007507
attcaatgactgtatatttagtcaccacctcaatcactgctaagctctcttcatgtctatctgtaccacagtttcccatcttagactgtgacgtcagctggcaagggctggctgttggccgattcatcatgactgacatggtgtgtcacaaagagctccaagtaaatgctgtgaaggaagaggatgaggatggagatgaggatcctgagaagggcccagactggctgcccaacccatggacctgaggcctgagtaaggctgggagctgctttcccctctgcccaggaactctgtccaggggcgattctaaggcacagtggtgaaggacatgattggtcccccaagtgtggtcctcaggtctcatggcagccactcgcc

SEQ ID NO: 19 - DNA, 265 bp, Homo sapiens
  Genbank Accession No. AA007629
tctggaaaaaacacgctttattgggtagacaaataggcctgatgggaaggcctgagtcacagtgcactggggagtgaaaaagtaggcaaagtgcttgaagcttcccctttgcccccaccttaacctcctggggagcagctctggacactcagtacccagacctgggctcagcaaggcctggggtgactgtgcccctcactcctgctgcctgatctgggcagcccacccttcactggtaagacagaattctcaagggataggcgca

SEQ ID NO: 20 - DNA, 443 bp, Homo sapiens
  Genbank Accession No. AA009719
ttttttaacctgcattatcgtttattgtgatcctaattcggtccacagtaacaattgaaactgcctcgactaaattttaagtttctggggcagcaccacctgaaggcagtgactgcctttttaaaagacagggttctgacattcagagatttctgtttctctatccatcatttttgggcatcttgaatcacctgatttagagtcagtgacatcctgactggattggttctgctctcgctgggcgggtgagacccccagacccacgtccacagtgcacctgatgttctcccagcggtcgtcacttccccaaggaggccaggtaggcataccagaacagagctgccaggttggcgaagagcacccggaacttcagagggacgtagttggatgttgatgaactgtagtggcgtccacacccgccagttcatcctcagcgccggcca

SEQ ID NO: 21 - DNA, 355 bp, Homo sapiens
  Genbank Accession No. AA009913
gaaccactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcacgggagatcacagcaacctaaataaaccagataccttttca

SEQ ID NO: 22 - DNA, 484 bp, Homo sapiens
  Genbank Accession No. AA010065
ttttttttttttttttaaatgcaacatacaaactttattgaacaaaagtaaactgtttcagtaaactcaaacaggcacttaagagaaaaactgactggaagaacttttatcttaaacatcttacagtaacctacttgcagttgcatttaactgagctctgttgctgtgaagaatacagctcatgcacaggtatggatgaaagatttgtacatttctcaagtattcactgaatactaccttatatacacatatacattaaatttgaaaaagatttgacgatccccagataaacttcatttttgttgatcttttggaagaggtcgtctaaagagaagaatatgtggttctggctcatgaatcatggtaatgaacccagcctagactctgttggacaccaagtctcctccactcctcttcagacatcagatgagttttaggtacttgtttggaaagttctctggggtaacataacatgccggtacta

SEQ ID NO: 23 - DNA, 390 bp, Homo sapiens
  Genbank Accession No. AA010205
gagacttgtggttttatttatttctgacaatgttacttagctcttctttccatgtgttgggttaaggcagaacgaaatacttctactgcaaaatcaacttctggtttagtgatgcacattgagggcgcaatggaaatgtctgagaaaaaatgctgcctctgccaacgaggagtcccatgtgcttgcagtcctcatggatctgatttacttcttcacggggaagaggccgacagcttatcttatcctgcaccatttctatgcctatcatgaggcctttgcctcgggacggtctccaacaatttcaaattcatcccggcagcttagcaaacttttagtaaacatgtaaggtcccaaacttccttggactggtttttcccggtaagaattttc

SEQ ID NO: 24 - DNA, 258 bp, Homo sapiens
  Genbank Accession No. AA010360
acttcttaaaaataatttattgtaccacaagtagctattggtagagatgaaagctaaagcagaatgatggaatacagttgatgaaactttaagaagcaatgtagcatgtaatcctcatagcttactgtcaggatgaagcctttatgtttacatccaagaactgagttcactgatgtcaacacctaagggaatgttctttgaaccacacagcagagacaattgtcatcaccttggttacagctgtatctcagattggtc

SEQ ID NO: 25 - DNA, 444 bp, Homo sapiens
  Genbank Accession No. AA010530
  unsure (1)..(444): n = a or c or g or t
nttttcacttttacaaattagtttatttccaccttcacaaattcatgcgcctctgaccattatgcaaggcancatgaattaaatacttatgtcagaacatatttgtcttacattattcaagataaagtggattttaaaagcaagttgggtaccaatgatnggggagattgaggagaatagggcaggcagcaacagggcaacatgcatttttcaagagtgtttattaaaataggcagtaatcagtacatgtacatcatatgagcagtttttcaaaattagcacttccaggagaggggctacatctcagttttttctgtctgtacagtaaaatgccaaaagtacttccctaaagtacaaaggcatttccctagtagtcttggtaccagtaacaatatgattactaaacatctccaatgtggtttttcattacaaagaaacatgttt

SEQ ID NO: 26 - DNA, 465 bp, Homo sapiens
  Genbank Accession No. AA010605
  unsure (1)..(465): n = a or c or g or t
ggaccggggcacgctttaatcgggagggctggagcagagggcggccccnganggngtngtgtcagtgtgggcggcttgnggggccgagtccgctggtgggctgnacccaaggggagcagccagtagggaagttgggcgagttccagaatcagggggcgtggctgtgtggctgtggcctccgtggggtgggcggggcttacatgccgggcaccaccccattggtctccatgttggtgaaggttaccccgcaagttctgctcctcctcgaaagccttgaacagtgagttgaagttgccggctccaaaaccctnggtggttgttggcgctggatgacttccaggaagagcgtgggccggtcctgcaccggtttgggtgaagatctgcaggaggtagcctttctcgtcgtagtccaccaggattttcagctcctccaagggcatcaatgttctccttcaacttgatctt

SEQ ID NO: 27 - DNA, 485 bp, Homo sapiens
  Genbank Accession No. AA010619
  unsure (1)..(485): n = a or c or g or t
ccatctattttcctntaataaacttcagcacggacacaaattcgcccaacatgtaaaagtgcaattccgaaaggatcctgctagaacaaggtccacggtacaaaagcatcctatggttatgtaactgcagcggccaccaagcgtccccctctgggctctggagggtttcggccctgcctgcctcccccctcctcctggggcagctgggacaggggacccctgtttgaagacagcggggacaacggcccgggaggcagctgaattgcccattgtgaggcccttcttccttggcactgcctgaaccccgtagcccactccggctgcccgggctcttctgccttctcctggcaccagcctccgggcccgggccagcttgctaggagagcgagaacactgtttctgaaaggggtgctgcttgcttctttgttcccggttttccgaaagcgngaatcccgaaacgccgtgagaaacctcaggctctggcg

SEQ ID NO: 28 - DNA, 507 bp, Homo sapiens
  Genbank Accession No. AA010750
  unsure (1)..(507): n = a or c or g or t
ggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttcttctttcagctaaggctagctggtttggagtagaatggcaacttaattctaatttttatttattaaatatttggggntttggttttaaagccagaattacggctagcacctagcattt

SEQ ID NO: 29 - DNA, 439 bp, Homo sapiens
  Genbank Accession No. AA011134
tttttttttggtttagaatgaagtttttttttttaattatttttcttggaagtagggaggatttgaaagcttgaaaatcaagaatcaaaagacagtgaatctagaaggcatctgggagcagaacagagattgaagacgggtgggcacaggagaaagcgccaccatcgatcccggctgctgccctggaaatgtgattttcttaatagctgagttcatggttgcttgaggtcaggcctggctattcatttccagcgatgtctgaccagagaggactcatcattgacgacctcagggtcacgggggcgacgctgacaccggaacggcagcagcagcaggacgattaagacaaggaggatggctccacagacgctcatgagcgccataggacacaatccacaaaatggggctcgctcaaagactgagcggggacacagtttct

SEQ ID NO: 30 - DNA, 446 bp, Homo sapiens
  Genbank Accession No. AA011209
  unsure (1)..(446): n = a or c or g or t
tgcctggcccagactttactcgctcccggccccacggacnaaggaacactgccgcaaacgtcggggcccagcctgagaggagcctctggncgncccaggcctcctggggatccctgccaagctggccccgggctggaaggtgcatgggcagcacacgaaaccaggatccacccactgcccaccggtggccctcacagctccccgggatctgtgtcctcagtgcaaagggcctggcagggaaagctgggcctgttggtcaggcatggaggagctgtgtggtcactggccactggctctcttctgcaccaccgccggctctgacaantgcctgctgctgcagctgctggatcagctccgccacacagatctttgaacaggggtacagggtccttctcctccaaaagtctctgcttctnaatggcctcctccagcgtgaggcccacccn

SEQ ID NO: 31 - DNA, 404 bp, Homo sapiens
  Genbank Accession No. AA011383
  unsure (1)..(404): n = a or c or g or t
gagatggagtctcactctgtctgccaggctggagtgcagagcgacactctatctgaaaaacacaaaaacagaaacaaaaccacacacacacacacaaaaccataaggacttttggaaacgttttacgatgtgttggaagtgctttcagattaattactattggagcaaaatgatgaagtgatgtatcccaaaccgtgtttataagtaattcaagtattagctagccatctactatgtccaagcaatgtgcatgacactgaanggtggaatggtgggcagcccttacagagcggtacaaatggggtcaatgcgggtgcaaacacagttgcatggcaggttttggtngctaaatnttttaaggattgggaggaccacgcctaccttctccccagggaaaggggata

SEQ ID NO: 32 - DNA, 459 bp, Homo sapiens
  Genbank Accession No. AA011679
gagacagggtctaactctgtagcctaggctggagttcagtggcacgatcattcctggactcaaataatcctcccacctcagccctccgagtagctgggactacaggtgcatcaccaggcctggttgattcttttttattttttgtaacaattaaataataaataaaaatctcactgtgttacccaggctggtcttgaactcctgggctggagtgatcctcccacctcagcctctcaaagtattgggattacagatgtgagccaccatgcccagcccctgttctctcaactggccaaacaggaaaggacctgcgaatggtcactgggagcaggagaccagtcagagaccaggagcaaagaaggcctagcttggcctggagagagaagcacatccctggttagtggttttacagtgccctgctctctattgcctcacccttaaaataaacaccacaccctc

SEQ ID NO: 33 - DNA, 502 bp, Homo sapiens
  Genbank Accession No. AA013095
  unsure (1)..(502): n = a or c or g or t
tgcacaaaatgcttttattactctaagcaaataaatcaatcaaatcacatttcccattagacagcacctcagctcccctatacatacagcagttcgctggattgaatacacaatgaacaactgaaaatgatcaatttccatcattctgataacacgggcaaaaaattcaaactctctgttagaatacaggtactagtaatcaaaaagaaaatttcttgatatctcccactagcattttcagatttagaatttaaccatgaagtacatatctagaactaatgacagaaaaatcgcattttaaaataatattacagttcttctgtaaacctcagagtgatttctgtgtggggaacttggctgaccagaagattaaatgagaattttgtacntccctcagatagccaaatagagttaaagggccactcccacaccacccccttccaaaaaaaaaccaaaacatggttttcccnccttttttaccggatattgaccaccagtatag

SEQ ID NO: 34 - DNA, 482 bp, Homo sapiens
  Genbank Accession No. AA015768
  unsure (1)..(482): n = a or c or g or t
acgtgttcaaatatttattttaacagcatcttttggaacatgtttatttcccttaaaaacgacacagaggaaacatgtacactgtaacaacaccttcccctctgtttctccagaagaaaaatgtttctgcatgcctgataacagatggtgcaaccaacagtaaacctggctctctacaccagtgaagaaccattctccaaatgcccagtgtgcctcagaggaaatatacaatttaaaagttgaccctgtagcaaaaattttgagtcaaattattaaaatttagaaaagaactggattcaaatacttacaaactaggcagtttttaaaactagacctttaagaccgtcctgggtcatccataatatatcagagtcactcttaggggtgggtaacaacataaatagtattttcacttaacgtaaggctagtcccatggaataataaaatccaacagttgggggntaaaaatttaattccanttt

SEQ ID NO: 35 - DNA, 248 bp, Homo sapiens
  Genbank Accession No. AA016021
  unsure (1)..(248): n = a or c or g or t
tcatattgtacaactatgatattaggtattaagcgacgtaattctttctctactagtgaaccagtttatttcacttagcaaactctaaattgagggaaatatataatctgagaacacacagaaaaatatattgaaaaaccaatagagaattatttttaaccatcataaaaactcaatcttaattaactgatagtctttaacttaaaaaaaagagtaatcnagattggaaattgggaattaaaaatatt

SEQ ID NO: 36 - DNA, 406 bp, Homo sapiens
  Genbank Accession No. AA017146
agatggagtctcgctgttgttgcccaggctggagtgcaatggcacaatctctgctcacgacaacctctgcttcccgcagccaggttatctcagaagccaattttccctttagggaaagttacagaatcagccagggaagaggaatgggaggatgggctggatgatccctgttcaggcctaatccgctggcctccctggggcctccctttctttgtgccaagccctgtgctgggtgctgggaactgggaacacagaatgaatcagacatagcctttgttcccatggggctcagtctcatggggaagacaaatgtgtatcaggcattattgacccaggatcatcagtgctccaataaaaagctcagagggtgggttgggaaggcttcctggaggaggaggtactggaa

SEQ ID NO: 37 - DNA, 321 bp, Homo sapiens
  Genbank Accession No. AA017192
ttttttttttttgggtttaaagccaaattttatctaacctttaataaacaaatcaatggcaataacaaaaatttaaaacattcttaattttgaatgttaatatatgaatgctaataatattaatatcaattttgaatatttggacaaaaatcccaaacaaaatattcataagataaattaagcagcttatcaaaacaataatataccacagctaagcatattatatttcagaaatggtttaaaacaagaaatcagaatgaattataacattaaaatagcagaggagaatgatatatgaacaaagcaaaagaagtgatagga

SEQ ID NO: 38 - DNA, 452 bp, Homo sapiens
  Genbank Accession No. AA018346
  unsure (1)..(452): n = a or c or g or t
tctcagtaaacattcatttatttcctgccagcaggtgcagtggggccccactgggnagggggactggtgttctaacaggagcgagaaaatgaaggaggcctggcttaagaccagacatttgaagaaggctccaggcagggaaaggaaaggagaggccaggccacactgtcccctccctgcccccacgtctccagcaacacaaggcggccagtggaccgtgaaccatttatttccaaactataaagaaacctgctctctgagaaaagacactgcccaggtgatgaagctccagcccctggaggtccaaaacccagtccaaactcagtccctttagaaagctgctgtgcctttggaaatgagtctcggctgtcagagcctgggaagtggtgggaagaaccagcccactcccctctcctgctgcgattccagcgcagtttggggcccagctctgg

SEQ ID NO: 39 - DNA, 427 bp, Homo sapiens
  Genbank Accession No. AA018867
gtttacatcatattttattttattacagtcaataaatatacttttatatatgaaatcattatagaatacatattttaaggcactaagtctcaaaagtgaaggcacctgttatactttgctctctaatttgacacattaaaacatgagaggtaaatctgccaatttattttgagtttgcaagcttacaatttaatagaataaatcaggtagcttcagaaatcaactaagaaaattaacaggctagagtctgaactaataatcttgacatggtttgattatcacttggtttattctgattactcatttaccttttcatttatgaatctaaactgacaattccacctttagaggtataatagagctattaaccgatgagacacatctactcattctctggtaactctgggacatcgcatcttgctttaaa

SEQ ID NO: 40 - DNA, 417 bp, Homo sapiens
  Genbank Accession No. AA018922
aagtgggagcttttggtgtaaactttcctgcagccgttaaagtggcaccggtgcaccctcctcctgccgtcgggggaggcatcgcatttcccttgtcacctggcttccccgaagtcccgctgcgcaccttccctggcgagggcagctccccgggcacgcaaccccacagttgagaaggttccctgctcagttccggagaagatggaggcgtggaggtgacagaggagctcaattttcccgagctgaccaaaacttcgccaatggggtcggaggtaaacttggccgttgggaagaaagttcctcggagctgtcagaggattcgctgctgacatctgagttcaggctgttggtctctaagttgtaacaaaagctcgggctgatgagagtgtcctctggaggactggaagatatcttcaa

SEQ ID NO: 41 - DNA, 487 bp, Homo sapiens
  Genbank Accession No. AA019715
  unsure (1)..(487): n = a or c or g or t
ttaagagacaagatctcactctgtcaccaaggctggaatgtagtggcatgatcatagctcaactgcaacctcgaactcctaagctcaagcaatcctctcacctcagtctcctgagtagctaggactacacagtatgtgctcaacatgactggctagttaaaaacatttttttttttgtagagacgaagctccaagtgttgcccaggctggtctcaaactcccagcctcaagggatcctcctgcattagcttcccaaagtgttgggattacaggcatgagccaccacacctggcctctccataatgatgttgagaccatcctcctcaacaaagaatcagtcagttcagcacctaattttcccacactgaagtctacgcaattttcatgcagactgtgcacacagtacagtgcacaaatccagagggcaacacattggtaattcatatcatccggttttccaaagtatgacatatgggacacctggagn

SEQ ID NO: 42 - DNA, 440 bp, Homo sapiens
  Genbank Accession No. AA021549
aaagtcattttattggacacaaatgctaaaaattagaaaaaccatacattttactctatcaatctgttaggaaaaactatagaatatgatagtgattgcattgattctgcttagcaaattaaatgcaaaactaagatattcaccaaatataaaatatagttattttctaagaaataaaactcacacaactgccatttttagcagaatggtggcaactgccatttttagcagaaaccaaaactatttcctgttaacaagaaggaaaaaccatcagtgaacactcaagtaataatcaggggactaggatggactctcagtaagaaaccactggaatatacctgggactaaatctattctaacaaaattaagtataccaaccggaatagttttgtgtgtgcatttggtttttactatatacttttataatctcaaaagtacct

SEQ ID NO: 43 - DNA, 418 bp, Homo sapiens
  Genbank Accession No. AA021623
ggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctggtttttcataaaatgctgacatcttcattggaaatttttttcatgtaactgttttcattttcagaaaatatataagggggtcattccg

SEQ ID NO: 44 - DNA, 394 bp, Homo sapiens
  Genbank Accession No. AA022623
  unsure (1)..(394): n = a or c or g or t
gaggctaatcacgtatttattttttcaaaaggttaaatgtaagcttttcccaactgaaatatatagaaaaccccaatgtatgaaacaagttttaggcattggtgttggcagcggtagtgggctgatgtgtcctccctgcacacagctgggggcatgtagcccttcccctctgggtgaaccctggggaaatcttggcaccctcagcctcactgccttccaatctcagctcaaagactgggcatcctgcctgggaccacggcccccccccccaatgtccctcaagggagtacaagaagtcaccangcattgactgcccatcctgcgtgtcctccttttcaggtaaaataaagaaggtaagcntagcttggggattttcgcgtgnccgaaagttnaa

SEQ ID NO: 45 - DNA, 452 bp, Homo sapiens
  Genbank Accession No. AA024482
ttttgctagtgcggagttttattggctacaaaatagatgcaaaatgatgagaatctgaaggctgcagtaggaaagtagagctttaccctcataaactcgcactttgattagaaaagtgcaatatattaagagcattatgagaagtctggtgagactgttacagaaaaaaaaaataaaagtttctgagtctgataattccaagggtatcttttagaactcactcactggtgtctgtgcaaggactttccttgggggaaaatagattttacaacaggcggaaactttcattggtctcatgcgtgcttttggatttcattcacttgacaaagaactaatcttccgttgatggtctcctgggttatggccttgatctttggagttgcagacactttcatgctcgactttgattcttcccgtgtcccttcactctctccctcccaggagccgtcggg

SEQ ID NO: 46 - DNA, 148 bp, Homo sapiens
  Genbank Accession No. AA024511
gttaattacagtacacctttattaatactggaatcttcacagtgcatctgttacttgtagcagtgactatatttaaatcggggaggatggtgtggaggggagaatttttccaaaatctgacggaaagaaaagaaacaaatggttcaga

SEQ ID NO: 47 - DNA, 437 bp, Homo sapiens
  Genbank Accession No. AA024658
ttttaaatatttaagagtttatttgagcagtgatccatgaattgggcagctccaagccagaagtggctagggagctccccagagagaacatgaggaggaggctttttaggacaaatagataaaagcaaagataatatttcattggttacagttatacagttacacagttatacagttgccttatttggtctatcccatgaggaagtcctagttactaattacgtttttgttggctgcttctgattggttgagcttaagttctgtgtttctttaacataggcatttacaagaaataccacaaataaagtttcagacatgcttgcaaatcaagcaaggttaaggtcacttagggggcccaactggctctgtctgctcaaggattcttctggcctcgtctccattttacatgaactggttgcataaataaacacagagta

SEQ ID NO: 48 - DNA, 441 bp, Homo sapiens
  Genbank Accession No. AA024776
  unsure (1)..(441): n = a or c or g or t
ttttcagggagatcattctttttattgccaaggaccaagaaacaaagtgtagaaatgctatacacaatggtcatgagctacaaggtaggaatggggtgcaggggagacgtggtaacacacagcactattctgaacgaactccagctctccattctaacacttgaaccaaggaaagacagcagtcctttttcactaagcctgcaacagaatgcaaatgtgacttggtttatcagctcccacaggacaggcagcgcaaaaggctattgtaagctggttttgggagcccccatctcaaacagagagtggatgctgaaggtggtccctggccgccactggtggnttgggtccccgggcttgctaggtcctgggcatgtctcgattctccaatgatncagctttgtcagtttgaatacagttgggccaatgtgggacctggtcgac

SEQ ID NO: 49 - DNA, 474 bp, Homo sapiens
  Genbank Accession No. AA024866
  unsure (1)..(474): n = a or c or g or t
gtctcccccatttatttggaaaacagaattacattaaaaggaaaaagtaacagcatgttgaaatttcacttaagtcgataccctttgatacaaactgggttattatgcatttataaaagatgccccttgttggccatggaaaagatacattttatgatctacagcggcagtatattcactttaagtaggaattaggaatataaatgcaaaaaaaaattaaaatgtcacattttctctccccattctacagaatagaatttttttgctccattacttaggagctcgcacctccctgcctccctgtgagatgccatgcacctgttgcagctgtcagcggttgttgccccctngaccattcctctgctctaccccttaccccaacacactccctcttcccttcccaaaggaaaccaatcttgtgctggggggtcgccttccctccacacagccacgggttcggacagttccctgtcc

SEQ ID NO: 50 - DNA, 343 bp, Homo sapiens
  Genbank Accession No. AA025166
  unsure (1)..(343): n = a or c or g or t
tttaactaaaatggtcacttttaatgggaaccagaggtatagttacaattacatagtccgacggggggaaacccttgggtgatcaggaatggggaaggttacaaaataacgagggtaacacttgggtacaggacaaaaagctgttccagaacctngggagccaggctaattaatacggcctctccctgcgatcctatctgtgctcacccctggaatccatcttgccagggccaaagccacctctntccccaccaccccngccccctcggaagcctccacggtccccgcctgcanccccggtangccgcctncgatcataagcntcctctngncaccactgacg

SEQ ID NO: 51 - DNA, 456 bp, Homo sapiens
  Genbank Accession No. AA025277
  unsure (1)..(456): n = a or c or g or t
tggcggtggtgaaatcaacgtgcttctttattttttaaactagataggctcattctactgtcttctccagggctcttctatgaaacagttacaaacctacggccaggccaggcagtggctcacacctgtaatcccagcactttggaatgctggggcaggaggatcacttgaggtcaggagctcgagaccagcctggagtatagggagacccccgcccccccccgccatctctacataaaatttaaacattagccaggtttggtggcctgtgcctgtagtcccagctactcaggaggctgagatgggaggatccgcttgagcctgggagttcaaagctgcagtgagccatgattgcaacattgcacttccagcctgggcgacggagcgaagaccctgtctcaaaaaataaaaaccaaaacctactgncagtttccccagggcttcatgcctcagcgn

SEQ ID NO: 52 - DNA, 358 bp, Homo sapiens
  Genbank Accession No. AA025930
  unsure (1)..(358): n = a or c or g or t
gccaatctgctcaaacacccagttggaacaggaatgcctcgtggactggctttaggagtttaatctagatggtttgctgtttctagcagcagagcacctgttcagactctacgtatatgcacccatgaatggtgcagctgccaagagaaccaaagctaaatgttggcaggatcacagcaggtgtggaggggaggtcactaggaattccctggagactcagtcgttacccactcaactggaaggctgagcatggctttttcctctgatggttacccatgccanggccccacctctccattgtccaatgttctttctttatttgtttgtttgtttgtttgtttgtttgtttgtttagaga

SEQ ID NO: 53 - DNA, 470 bp, Homo sapiens
  Genbank Accession No. AA026030
tttttttttttaccattctggctcacaactttaattgattgctttccctccacttgggcccaccgggtcggcttacatagctcatagctcagtgctgctgaaatagacccagggcaagaaaggtatgaacaaccagtgaatgccactggagcataaatgttcacaaaattgtagagaaggggtgacaagaagcaagcagtggggcagggagtgtcactgatgtccgaaaccccgggtcagaccaacacgcagcacagccactcggccagagagagctgaaccatgccatccttgtcttcgtccagaaggctgaatagtttgaagagggtctccaggcggatcatacaagccacgaagctgtcaaagttgatgccaagctttgctgcacgcataccgcagggcaatggtctgctgcacctggctgttgagggtgaaacctggccttcctgagggctgtcctcatctcgtgg

SEQ ID NO: 54 - DNA, 313 bp, Homo sapiens
  Genbank Accession No. AA026092
  unsure (1)..(313): n = a or c or g or t
gtggcatgcagacttgattttgnctatggatagggttacatacttggggtttnccccctattattaagggatgtttttgtgatcaagggatgaggcattcaggaggaaggttagggaaagatgctcgcatttatctancattgtatcaaagttggaggcagcagctaagattaagagttccatagactcctgcctgttgcacctccttaaagcgatacattttaacgttttcctcagcaggagcttgaatttaacaatgaatccagaaaaaaagagaagtcataataaatcacaaacantatgaaaaacaaca

SEQ ID NO: 55 - DNA, 397 bp, Homo sapiens
  Genbank Accession No. AA026150
ggagactggatatcatctttaattaataatgccacagcccaatgtcttttttgttgctgtagcaaattgtgattgtgtgtgcgtgtgtgagtgtgtgtgtgtgtgtgttcctgaacagatgaagggccagcagagactcccaagcaggtctcagccaacaactctgttgagcagcaactggaagatagtctccatagaggcacagaggccagacttctgcctcctatggcattgatcctctctcctgggccacctttcgtgcattgagggcaaggctgaggcctgtaccagcccagattaaaggacttctaagcacaggtcagcctccagttcccagtactcactggcctctgaccagagggatgccctgggtagagtatagacttccaggcagagg

SEQ ID NO: 56 - DNA, 335 bp, Homo sapiens
  Genbank Accession No. AA026270
caagtttcaatcatttaattaacatctttaaatgaaacacagttttcttcatgtgtctcactcaggcttcagggcagagggaatggatttttagacatatcaaagactcaaaaatttaaagaaatatatatatgtatatatatacttctaacattttatggaaattaaaaatcagaggcttttggtctctccatttactctaggtcaagctcatttaccccagaggacaaagaagggctgcctcttctagaccctcccttctcctttgtcctctgtcccacccagcagggaaacaagctcagaagatcctaacaggatagagttccagtaatgtt

SEQ ID NO: 57 - DNA, 287 bp, Homo sapiens
  Genbank Accession No. AA026356
ttttttttttttttttttttttctatctgtgaaaaacatttattctgagaatctaaaatctggacaaagtactggactttagaaaaagcctacacaaaattgtctcattcttccctaatacattaataatctaagaataaggaggtgaaaaaaaccctttaaaaataacattgctccagtttgtctgcaggtatgtgatttaaaatatccctgttttattgaggtataggctgcaaactttggtaaaattaggaaaaattaacaaaccctttcaaaagaaaaaaaat

SEQ ID NO: 58 - DNA, 434 bp, Homo sapiens
  Genbank Accession No. AA027766
  unsure (1)..(434): n = a or c or g or t
ggttgtaaatatttatatttctctcacatacaatgttgtatgagacacttgttttaatatgtatccataggattaatactcatatggagtataatgtggaaaagtgcagaactaaagaaataagtctatccgaaaacaaaagcacacatttctcaggatttaaaaatattgcacatagtaaggttgcacagaaattactggctggttttacaaacagaatgaggtatcagtcaatctctagataaagatgagagagaggntatnctacacacacacaancacatttntccatnctaagacccagagtgccaacaacttngaagaaatntgaaaaagtatgttagtagtntgatttcaacacttcaaaatcattttnggntgggacccnacanatacaactctngggaaattcgngaaagtttcancttttccag

SEQ ID NO: 59 - DNA, 392 bp, Homo sapiens
  Genbank Accession No. AA027833
  unsure (1)..(392): n = a or c or g or t
tttttttttgggtgcaaggaacattttattccataactgtctccaccgaagccgcagaagcaaagccaggagcagaatccattctgccagcgctgggctctggggagacatctgtgccctcaccatggaggacagaaggcaggggctcccgactccttggtcctgcctggggtgctcctgtccctctttcttgctgggggacctaccccaccctccccctcccacctcagccacagaggaacaagggagacaaactgagggctctgcagtccccgttcaaggccaacataatagtcgtgtggccccagcccagctaggcgcatcctctncggcatggcagcggtgaccaagcacagccaacgtcagctccgctccctgccgtctgagagctg

SEQ ID NO: 60 - DNA, 386 bp, Homo sapiens
  Genbank Accession No. AA027946
aagagttcataaaggtgggagccaaggggccagagcaaatcaaaagctgcaaaggcgccaactctggtctccacactatttattgagtacaatcacttagatctaagaagcagatgttcaggggtgaaacagtgaaaggggggcaatggcagtttaggtacattttctttgtgctgaagcagcataaacttaactactgatttattcttttacttatcagagagcagctgtggggagtgggcctaactagaagccagcatatctggccacattccaatgcttcaaaggagtgtctttctccttgagcacagtgtttatagataagagagcaggtcacactctggtcataggaacgtgatggcaattaggaggctttcctcctcagt

SEQ ID NO: 61 - DNA, 484 bp, Homo sapiens
  Genbank Accession No. AA028103
  unsure (1)..(484): n = a or c or g or t
cagttgtttgtttcctttaattaacatctaaatagattatacatcttctataattataatatggaaatgtatatgagcaaaatatataaattttttggtgactgcttagggaagaatgatgtcagtgaagttcatccaaggtcttaagcagcagcatctatgcagccagggcgtggtcagcgtttggggacagaggtaaatatccgcaatccatgcatctctttgatttcttcttttagtgcctgattaaccatctggtgctgctggacagttctcttctccttaaattcttctgattcaattttaatttcatacatccgccccacaacctcctgaaatgtcagtgacttttatagctgtagctcgtgggaaacttttcttttgagaatttgggtcactctgagctccccctcagtctgagtggcaaacatccgatggtgaagtggaagcccgcggatcccgnaaggggagaggcgctgcgcaa

SEQ ID NO: 62 - DNA, 322 bp, Homo sapiens
  Genbank Accession No. AA028132
  unsure (1)..(322): n = a or c or g or t
tttttttttgtgggagacccatttaatgtggacactcaaggcctgggcagagtggggagcgcccaggagttgggtgggcaggcaagtgggtgggttgcaggcccactcttggccccaggangnatgccaggtggtgggggctggcccaggtaggcaagggganncccaggcaggaagggtggcccangcaggcagacccaccaggggtccctgaaggccagcccttgagaaggtgtctaaagccaagggggtgagtgcccaaggccangagcctaacccagnggaggcaanggtttgggtcccgntttgggggctcttngag

SEQ ID NO: 63 - DNA, 402 bp, Homo sapiens
  Genbank Accession No. AA028976
gtgaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgc

SEQ ID NO: 64 - DNA, 424 bp, Homo sapiens
  Genbank Accession No. AA029215
gacagtagacaatgttgtttatttaaaatgtttactccaagaaatatatatataaaaaaaataataagacaattacagcactaaaccaggcaccttcgaccaaatcacaacctcctctttgattccccttcacgctaagcctctttcaaattctttttcctgagctggaagaccagtcagatgcccgcagtcaagcgccaagcacattcccaaccgggcaactgtgtacctttctctaggagtgcacgacacccttcccccacaactccttattttaaaggatttaacccattaggaagcccatgtttcaatctaagccagaaggagctgcgggacaaggcagtcttcactttgaaggtccctttcctgctccagtccctggggctagggttctagaagaggctggctgccacgtttacatgag

SEQ ID NO: 65 - DNA, 485 bp, Homo sapiens
  Genbank Accession No. AA029288
acatttgcctggtttttattgagtggatctctcacgacaaaatcatgaatattacactgaaaggcttattacattatctttgtgtagttactctccagtataaaccctgtgatgttccggttttgatgcctgggtaaaagcttaagcatgcacgttacatttgtatggtttcatcaaaaaagtttttgatgcctagtgagactttggcctgcggaaaatctctatcacatataattattataaatgctctttagtatggattctctgatgttgatgaatgtttgaagtcataatggtttcccactctcagtgtttttgtttctctcaagcatgaatttttgcaatattgtacaatgtgagaattgtgccagaagaccttgccacattcattacatttgttaggtttctcaccagcaagaattctttgaagaatcctggtctcagattttaccttaagaccttgccacattcagtacattagtaaa

SEQ ID NO: 66 - DNA, 422 bp, Homo sapiens
  Genbank Accession No. AA029356
  unsure (1)..(422): n = a or c or g or t
gctctcagaggacaagaattatgttttattcatttgggagtacataggcggtatttaaacaatggtgctatcttaaacaccaaatatcaactgcagttcactttttccgtgtggggactaatatcaagatttcatatgaattatagtataatccagaagtatgaaaaaatacatcatatttaacttataaagcattcatctgcatgttataagatattacagtaaatacaattaggtacttaccattttatctttactttaaaaacaatgcctnttccaaaatataaaaaaaagacctatttttaaaganctatttaaagatngcttttgaaaacaacacttttatnttacnacaaatagatggtagtggcaacagcactcgtggatgtttacgngtaaataaaaatacctagtattccggg

SEQ ID NO: 67 - DNA, 186 bp, Homo sapiens
  Genbank Accession No. AA031360
  unsure (1)..(186): n = a or c or g or t
aaaatttaaaataaaattttattttatcttatactcaagttcagacaatagcatgtggtgtacattcaaaatttttgacaggtacagagcacattaaaaaatgaagacatgatcaaggagatgtaagagacaaatagacaacaacattctccctgaatctggaaaaaagcnagccnttagggtncc

SEQ ID NO: 68 - DNA, 501 bp, Homo sapiens
  Genbank Accession No. AA031543
  unsure (1)..(501): n = a or c or g or t
ttttttttttttaaaataaaatgttttatttgtaaattatgtacagaatacactttacgttacgccaatgaaanngnncnggaggagggagagccatcaccttccaacaaatgctgttcactttctctgctggagacgaccatctttctctcagtcagacgtacaaatcagtgtggatttcctacattggaaaaataatttagctaaaccagaagtgttgctgcattgttactagttggcttgtttccacaaaatagttttgaactctgctaactcagaatcttaaaagaaatctcctggtataattttataatgaaaaataaaaactatcaaggacaatgagtttacacatcttaaagaaactgtgaaatggctacataactatgcataattgtgaaatgttggagtttccttgttccctttaaaggttatntttgattagtctaacagtaaaaagccataaaactatccaaaattgccattaatgtaaatccncgtggg

SEQ ID NO: 69 - DNA, 464 bp, Homo sapiens
  Genbank Accession No. AA031548
tttttttgaaagggaaaaaaatttttttaattacaaactcaattcatttggtgcatttcaaaggtgcaatacttttcttcatttatcagtgaaagaagttagaaattaacttcccaaaaaaatcagcaaatggcaaacaaatgtccttgaaagtcacagtcacatatagtgcgtcctagaaaagaggaggggcaagatgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaacccccacacacactccccc

SEQ ID NO: 70 - DNA, 164 bp, Homo sapiens
  Genbank Accession No. AA031814
ccataaagcagtttatttttcttaaaaaggaaggtacatggtcacagtccaaaatgttttatacagctctcagcctggaaaatgcaactgatgaaaaaggcactgtttctagaacaaatggaaaaagaataaatatgtcatcatttaccctgcacagctttgag

SEQ ID NO: 71 - DNA, 313 bp, Homo sapiens
  Genbank Accession No. AA032005
gatagtgctttgtctttatttctgatgcccatcttcttcagaggttaagaagaaatgacactgatgtacaaatgactcaccaagggactctcacctgactctacccttgcaggggtggaataaatcccttctattttcaagtctatttgtcccatttctgtttagacataatttgaaagccagcttggaccttgtacttttcaattatgttaacgtaaaatactcgtaacgaatgtagtatgagtttaaagtgagcttttcagatcctataagtgcatcctaagtaatgacaggctttaagataaggaatata

SEQ ID NO: 72 - DNA, 550 bp, Homo sapiens
  Genbank Accession No. AA032048
  unsure (1)..(550): n = a or c or g or t
angattaccagctccggacccagtgaggggctgtcgcagccaacaccccggcctcgggcttcctggtggcagcaccaggggacacacctgccaaacccaccagatggaggggccctccctggtctctggccaccctcccagcctctgcccagggacccctgccttccccaggccatctcgctctgccgtcgacactcgtctcagaagcccctttcccagaagaggctggtcttcaagaagtctcgtttctttgcccctgaagtcatgtttcaggggaaggatgtgaaatttttccgtgtagaggttacagccttttatgctgttgagctcccaggtaccaaaaagcttgggccaacgcttgccagccagccagctgcaggtggcatctgcaggaaggaagcgccagcttcgccaggccagcaggggcgtcgttttgttgccattttgttgaacgttatgggtttatgggtgttcctggaacttgtctttgtgcattcgttgctgtttgtgttaccctcactgtcccatgttccacccacgtctacggcan

SEQ ID NO: 73 - DNA, 491 bp, Homo sapiens
  Genbank Accession No. AA032250
aataatactgtcatgtcacagttggtctataacaagcatcacaaaaatgtcaaataatctgtgccttgtaaaatccactaatgtaacatgaaaagcacaatttgacatcaacccgtgcagtgaacccagctgtgttactatagaatccttatctgctctttggaattactgatctctcaaaatctgactcagtttacttctagcccaaatggaaaagtcctcaataagccaggaaacagccctccctttggatgtgtgtctagtctacaaaggatggccttctggggtaccatcttgtgtctcccagacctttccctgtctccctcagtgtctgtgccccacaatacaacaaaggccacctggacacatctctccttacctggaacccaaagcagctctgcctccatgcctgccttggggagctacctgggcagacagctggaaaaagcaagaggagacccaggctctagttccaggccagcatgcaggct

SEQ ID NO: 74 - DNA, 106 bp, Homo sapiens
  Genbank Accession No. AA033790
gcaggtcagcaacaagtttattttgcagctagcaaggtaacagggtagggcatggttacatgttcaggtcaacttcctttgtcgtggttgattggtttgtctttat

SEQ ID NO: 75 - DNA, 433 bp, Homo sapiens
  Genbank Accession No. AA034030
  unsure (1)..(433): n = a or c or g or t
aaactttttttattttacattctggggaacatgtgcaggatgtgcagatttgttaaacaggtaaatggcaactttccttctttagtgagcaaatctttcagtaagcaaagtacaggtgttctctgtgatatttttatttttgcaatttatgtttaaggagcaaatctatgcaaggtagcatctttctagatcnggaaagttgaattcnttctatatcacagacctacactcacagttgacatcaccattctatgacaaagccnctaactacaacccaagcactntttatttaaaaggaatgttcatcaacatccactctccttggtcttgagccaagcccagaaataacaaggtcagatggtcatgatcaggaagaaagtaaactcagacttngaagaaatatactggccaattccccatattcccacccggc

SEQ ID NO: 76 - DNA, 387 bp, Homo sapiens
  Genbank Accession No. AA034365
  unsure (1)..(387): n = a or c or g or t
tagcagttcacatagtttattcagcaatataacaggagagaacctccattgtaagagacataaggcagatacagggtgcatctctggggtacattcttcatacagactaacaaataacttcaggtttcacaacatgtagcaagtatgatttgttgcacaccaacagccattcattcctcacgttttccttgctaaaagagccctggtcaggcacggtggctatgctgtaatcccagcactgtcggaggtcagggcaggtggatcatctgaggtcaggagttcagccattntttttgnattttttatagaagaccggattttcactccacaggttattgacnttaagtggnattaacatggacccattnggcacctaaactggctngg

SEQ ID NO: 77 - DNA, 439 bp, Homo sapiens
  Genbank Accession No. AA034378
gagtaacattggctcgtttatttcacctgggtgcaggcgggctgagtccgaaaagagagtcagcaaagggtggtggattatcatcagttcttataggttttgggataggcgctgaagttaagagcaatgttttgcagacagtgggtggagctcacaaagtacattctcaagggtggggagaattaaaaagaaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacagggggatgcgatggcttagcttggggctcagaggtctgacagttatcacctaagattctgacttttaattatatataacaattggatat

SEQ ID NO: 78 - DNA, 343 bp, Homo sapiens
  Genbank Accession No. AA034499
  unsure (1)..(343): n = a or c or g or t
ctaaaaccactacatagaataatggcaactttcactcacagattatttacatggtaatacccagcgtgggtacactgctacaaaactcanaacagaaggagtaaacttgaaatgttttccataataaagatctagcagcatgactatctaatgctgttttatcccgattgcttctgcaacgttcctttttagtctgtgtcttcatccagttcataattgtctttatcataaatatcttttactagaagaacccgtacaagcatattttccaaggtgtttcggtccagtgaagtagacgtataccagacagggctatctgtagaactagagcattctgggttgc

SEQ ID NO: 79 - DNA, 464 bp, Homo sapiens
  Genbank Accession No. AA035245
  unsure (1)..(464): n = a or c or g or t
tttttagtcatgaaattatttagaaaattgcctttcactatatggtataatttctgttggtggatagaagccaagtaggagtcacatgcaagtcatcacctattccatttagctggatggattgaagagacagagtaatgacgaatatcaccctagaggaaaccaattagtntttataacattgaaaatgatttatagattgcttaagcatatctatcaaatctaaatggaatactttaaatcagctccatagaaaagcaacactgtgggatgatttctgaactgtggaaactctgtctttcagatctagcatcttccagcacagagataggacagattgccatctgggaagaggcactctgttttctccagaagttttgcatttggattcagatgggtacattccaaggaaacgtaggntccaggttcatctctcggaatcattnttgtgaacttgtcttccc

SEQ ID NO: 80 - DNA, 173 bp, Homo sapiens
  Genbank Accession No. AA035457
  unsure (1)..(173): n = a or c or g or t
gcaganactngagctttatttacaaacttccacagaatccctcaccctccaccccagggtcctccctctctggaactcaggcagcagacaagcttgggtccacccacctgcccaacctaggacagctgggcctgagctgggcgggcaggggattccatctcctgggtggggct

SEQ ID NO: 81 - DNA, 417 bp, Homo sapiens
  Genbank Accession No. AA035540
  unsure (1)..(417): n = a or c or g or t
ttcccaaagtgctgggattccaggcgtgacacccgcgcccggcccacagttttattctttacaggaggtcagtgcccatcatgttccctgtctacagacaaataaaaagctgctctctccagaggggcggcanagtcctgatggtccagtgagacccagaagcttccaggagaccttcagtcccgagtccctttcagtcatcatcttctgagtctgactcttctgtggactcagatgcgctctctggcaagtcgtctcccatctgctggaaccttcccgactgtgaatcccacatgtatttgatggtcaccttgaattcagccatctcatacccaaaaagcttcaggacgcgagcctgctctggggtcagcacatcgccctccttgcacacctcgtaagtcagacagcagaagtcac

SEQ ID NO: 82 - DNA, 458 bp, Homo sapiens
  Genbank Accession No. AA035638
aaaatttgaacaagtatttatttcttaaaatttacttaagggattagagctaatatataatagaacatttaatataacatttggagttatgtcaacataaaaatagctgtggttacaattagcacatgcaattcactgcaaaggtaaaaatacatgctatactctagacaagccttccaaatgaagttagagtagatggggtaaaacagcaagtgaacatgaaaggattgcacttagaagaaagtgggacatagctaggatataaaagaaacatacctaatgctagtcagtcactgcattgtcctactagcaaattgcacatttatttttagagtatattcaatacacatacatatttgagactagagaattttcaaatatctacctttgaaatatccctttggtttctaacacatcacattatggtattaatgtaacagcacttaaaacctgtagtt

SEQ ID NO: 83 - DNA, 444 bp, Homo sapiens
  Genbank Accession No. AA036662
  unsure (1)..(444): n = a or c or g or t
acaccggcaacacataactttattgggtttcttgagctctgtttataataataatatgaanacnccnggtnanaagctnnangtntganaangcannnntncannnntcccgccccccaaaagcatttaccatatgcaaggcaccatgttaaacacttgagagatccacaacaatacataaaacaacattccaaattcatgctgagcacttttttctgaaacacaagaacaaatctgaaaagttaggtatgtgactgtcccaaattttggtattatcatacagtgcaggaagaaaacagggataggtttatcccttgaatttatacaacttcccattgctggactagtnaggttttcatngggaattttncttctccttttaaaaaagggctttaatggtggnttttccattngggcacctaaaaaaaaccccccccnccccaa

SEQ ID NO: 84 - DNA, 393 bp, Homo sapiens
  Genbank Accession No. AA037058
  unsure (1)..(393): n = a or c or g or t
aaannnttacaaatattcanattttattataaataaaatactgtttttcttaaaacataaaaatgccaantgttgcattttattaaccaccccngagancaangctgtaganattaaggcaaacagctaaagtgaaggcacatataaaangtccacanttnnaattcaaaggaaaaaaattcagggaaaaatagcagtataataatccctgtgtcaaccagcattctgcancanccatcctgtcaattacattacataaaatacagataactggagctagacaataaaataatggctgtgttgcgggagtgtaatttaaggtatcatcttgtaaagaaccttttattttaaaaaataaaattctgcttaaaaaatataccacacaggtgggng

SEQ ID NO: 85 - DNA, 273 bp, Homo sapiens
  Genbank Accession No. AA037357
ggagatagggtcttgctatgttgttgcccaggctggtcttaaacttctggcctcaagtgatcctcccaccttggcctcccaaagtccttggatttcaggcaccagccaccatgcctggccacaaagactatttaataaggaaaaatcctcaaaatgttacataaagatcacatcacaaaacttttacatacagtgttattctgatttatttttgaaggggtaaggagaaggaaaatatatcacttttaaaacgtggaactttcaatttgttgt

SEQ ID NO: 86 - DNA, 498 bp, Homo sapiens
  Genbank Accession No. AA037433
  unsure (1)..(498): n = a or c or g or t
ttcagttcaatacagcacacctttattgagcacctaaggatctangctgccanaggagggcagagtcgacaaaacagtgggcaggcctcccctgcagctctctgtgtctgtgatgatggagctgggttggggaaatcctgctgtgacatttgccctgacgcagttccgcacagcatggtggcttccaagctatgctcttgatgggcacccgtaagagcttctacatgcattagagatggagcctctcctatctttgcaagcctttgtggttcttccctttaaatctgccatccacggacctcaacaggagaataatttggtcttcagtttgctctgttttagacaaatacttcacatggactggatgtaaactgttgcatagtttcgcaaaggctttctcattcattcctgaaattctccatcagtcacaaacacaaattgttcagtatctggggaattcaaagccctttcctcaaaacagacatttctcctcgtgcc

SEQ ID NO: 87 - DNA, 551 bp, Homo sapiens
  Genbank Accession No. AA037766
  unsure (1)..(551): n = a or c or g or t
ntacattatggaaatttatncctcctgaatgtataaggcaggagactaattcaatatacattcactatgcagaattctacaagttctgggctatgtgtaaatgtgccccccttccctccattatcaggatgtttaaatgtgtttcctttttttcatttaaaactttgcttagatgttttacattgccatcacctcttcctgagaaaaaggtgtgtcccccaccccaacccctaggagccangcagactatcttnctgaggggccacaagcacactcccacngtggagaacaagggcagtggatgaagggaacggggatttttcaaactaatgttttccctcaaacaggcctcccggcgccngttagacttgaagcaatgacatctattaaaatggggaccccagctgggggttaagaatgttngtttaagaatgatgacgatatcttgaaaagaaattcttggctggggatggngtagggggaaagggaaaaaaattaattattttgactttcccattggcaatgcttgctacgtttaatctgattgcatt

SEQ ID NO: 88 - DNA, 456 bp, Homo sapiens
  Genbank Accession No. AA037828
tttataattagaaacactttaattcctagccacttggcagcacttaaatatcagagccatccaagcatgccagcctttgaacttgctcagcaagagtagatgatcacacaactcttaaggtaaatcaaaattagatgaaggttatttattggtgtgacttttttcctttagtgagcttcctttacacagcatggtgtaaatagcatcagattgaatgaaaagtttgttaaatgcaaccataaataattataataaatatacatcaagtaactttacagcacacattttttagggccaaggtttggatctgtctggacctcaatgtgctctcggagaagcagccacgttagcagcagataccttacagcttgtcatctactcaagtgatggccaacagaagcttctgaactcctcccggggagggtagctgacaaggtccattcaaggggatgagga

SEQ ID NO: 89 - DNA, 452 bp, Homo sapiens
  Genbank Accession No. AA039335
  unsure (1)..(452): n = a or c or g or t
ttctcagcattttcaaagcactttattgagttcctgcgccatcctgngngangctggccgcactgggggaatgggacacaatcttgccttccatgccccagccactctctcactgcggaatcaccaaggagggaaagatgagtccctgagcaatcaggaaacggtgtgctcccggatccaggccaggtagtaggccacatcggtgtagacgcctggcttgttgcggtcaccacagcccgatccccagctgatgatgccttgcagggtgagccggcgctctgcaagcttggtcctcacacaccagcgggcctccggaatcaccctggcacgcatcggtgccgccctcgaggaaccctgcgcagagcatgccggggaggatggaggatccgtgcacgtccggggctgagcagcgctccagggagaggaacggtacctgcgccttccctcgtgcc

SEQ ID NO: 90 - DNA, 428 bp, Homo sapiens
  Genbank Accession No. AA039616
  unsure (1)..(428): n = a or c or g or t
ttcaaaatccttatatttttgaccacataacttatgttcccacatgataaaacaagtgacagtttaaatcaatgtcaacagataaactccatgaaatgaaagtttgtgctgtttgatgaatcacagtatgttatggttaaatatatccactcttttttatattcctggcaccaggatgaaaaaaaaaaatctttaaatatacctcttatgtaggtaatagcttctttgcatatctctcttcaanaaatactttatngcagtatataaatagggttacctacacatttcattttataattttgtcccaaaactatagatctgtttcattttcatgacatatcaatttttgcccaacattaataaagctgacaaactcggttgaaatgggaaatngctttttgtcttcccacaacaaaagtagcnatttt

SEQ ID NO: 91 - DNA, 457 bp, Homo sapiens
  Genbank Accession No. AA039806
gagattgttctcatttccaaaatcgtcagacaccgatttctctgcgcttttcttgcctggtgtcaggacagggaaaagctatgcaggagacatggcctctagctctgttcaactgtcaattctgctggggaccctagataaatctgttaacctctctgccctcagtttccccatctttaactcgagagtgtagatctaaatgctagaagagtactaagggactcttccagccactttttggcagggatcagacttcggagagtgaactcagggagcaaagaggtgaaactggagcagtgtgagggttaaagggaaggcggctggcggtgccgagcaggggagcacgtcgggggtacagcaccagggctggaggaatcggctggcccacaggtgggcgacctgggaccctctatgtcaggtggtacatgctgtagcccacatgggccgtgtagagtcc

SEQ ID NO: 92 - DNA, 471 bp, Homo sapiens
  Genbank Accession No. AA040087
catttttgtacacaaggccaaggtcttgggccacagacaaggctatagatcctacgttccagcttagagcattcagcttttttttttctttttttctccaacatggaatgtcacacagccttgcttcagtcactgttaatactagaacaaaataggctttcctgcagttttttcttggacgtaagaagtaaaacgttttagaaatttaggatactctcgctttgccactgcccttaacactgaggctggtgcccatcctccagggttcacattagctacatatgtaatcttgcatagaatgttgtccctgctaatttcctggtttccctctggtgggcttaccaaggtttgacaaatcatagcaacatttattttggcacggacacatcggttgtttagaggagcactgtcatgatccacagaaaaattacaaactatccaagtttcagggtcattttcagtcaaggctgg

SEQ ID NO: 93 - DNA, 440 bp, Homo sapiens
  Genbank Accession No. AA040270
gagatattcactttattgcagtggtctgaaactgaacccacaataactacaaggtatgcttgtaaataccttatttttaacaaaaagtgaaaatgatttccctgttatttactaacaaatagaccagacatttgcatcagacagtgagcataaacttctctgatcacctctcaagagacatctcccatttctcttttgactctcctcaagatttcctgtaagaccaaactttatcttccatatgtctcacaggtcagtgttcataataaccatcagttatacaacagcaatttaatgaatctcagagtgaagacaaattgccggtttctgagtagagggccaggataggtcacctggatactcattgaaactaatgattctcaacttctcctgccttcaactcaccagaggaatattagacatccacttgttagtggttc

SEQ ID NO: 94 - DNA, 463 bp, Homo sapiens
  Genbank Accession No. AA040291
  unsure (1)..(463): n = a or c or g or t
ttttttttttttcaacaaaactgcagtttaatttcagaaaatgttaaaatatatatttatacatcaatttctgacatacacttaatgtgttagtatacacaaaatgatgctttcttttgaaactgtatttangaaatgtacattttaatttaaatactcagtatacactgcacttaatctgcatgttgcatttattaaatacattaaaatctgcaatgtaacaaaacgttttctgcatacgaaattcaaaacaccattttaaatgaacaaaagatggctcacttttttttttttttttttacaactagngtatngtacactagctcagctccaccaaactacctgntcgttcncctttatttgacattggttcacagacnagtacatattacnataagagtgcnggataaaaacctgnggtacgaaagtgggttcccaggnttttagggncctggcaggatca

SEQ ID NO: 95 - DNA, 325 bp, Homo sapiens
  Genbank Accession No. AA040465
tttttttttctaacacttatgcatttattttcatgtgtaagaagaaaaacgtaactagcacgtgaacatgactgcatggatacacggctcagcacgaggctaaagtcagaagtgagtgaaaacaaaatagcatgttgatttaagtgaaataacagaacaggaggcctttgtttataacaattgtggaggtggtctgtgaatgcagaagttcgggactccctgctctaggctcagggcaagacgctgtggtctgggccgaagcccttggggttctacagagaagcctgcccagcgcacggcccctgtggcattctcgttgggagcg

SEQ ID NO: 96 - DNA, 494 bp, Homo sapiens
  Genbank Accession No. AA041208
  unsure (1)..(494): n = a or c or g or t
gagtccagtggctgcaaagggcatcccggaacgtgatgccgctggggcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacanggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaaggcggtgaatc

SEQ ID NO: 97 - DNA, 245 bp, Homo sapiens
  Genbank Accession No. AA043111
  unsure (1)..(245): n = a or c or g or t
gaaagccctgtctactgtctggagttcaacagccagcagactcagctcttggctgcgggcgatgccagnggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagca

SEQ ID NO: 98 - DNA, 590 bp, Homo sapiens
  Genbank Accession No. AA043501
  unsure (1)..(590): n = a or c or g or t
atatgcttgcaggttatatcttagtgcaattcagtcccaaatactttaattttgaaaagaaaaaaaaacatacatttttgaatgtaaaatacccctacagatataaacaggggcgtttcccctcttaatactttggttttcaatacagtcagtggtatagcaaagactacacatacccaacttatatttaagttgcaagcacatgctgtataagctactttttttaaacagtccccttgcaaactctaccccccttaacatcacaatagtaaacaatttagtgcatcaatcgtttaaaaaatctacagctaaacagacctaactctttcaaatttatctataacattcctttatctgtagcatacattttaactgggctaacagattataaaaactagaattaaattatatactagaaacccagagcattccacatttgacaatgaccaaaagccaaaaaatataaaataaaaataaaacaaaccaaaaataatggggcgtttcccttttaaaaaataaattttagctgcntctcggnaatanccaatttaggncccaagtggggcgccatctattaaaggnacattagg

SEQ ID NO: 99 - DNA, 417 bp, Homo sapiens
  Genbank Accession No. AA043790
cttagtatatactttaatgcatgtttatgtgcaatcttgttagtgggtatacaagtttgtgaagaacttctcatttcaataggcagttaatgtaatgcattaaaagcctgggaatttggggctatatttttcctttctgactcaataatcttcaaagaattcataggaaagtcagtacttgcagacaagtggttagcttggctaaaatgtacaaaacacccagaacccacaaaacactcagaggtttaggagaatgttttaatgcttaagaggcaggatcaagtgaaagaggttacagaaatcagtgtctctggctgggcagtcaagagagcgggctcaaattctgtgactcacttctctgtgtctccggttgggaaatggaatggggtatcctgggttcccacctttccccacacg

SEQ ID NO: 100 - DNA, 444 bp, Homo sapiens
  Genbank Accession No. AA043944
  unsure (1)..(444): n = a or c or g or t
ttaaaaatactcctttttgtaagtctttattttttagttgctcctcccatagtaatgcactgaaaggcataacagtttatattgtacaaagcatttgaagaaagtacctcaacttgctgattatttcaaaatgagattacaaacaaaaagaaaacaaatctggttcctcaataaagggcaaaataactgaatacagtctgttatttacttctctcttttaacataaggttgggaacacttcattttacaaataggattaacatgaacataacatcgcacaagcttgcagacaaccagcataaaatatggagtacagtttttaatcagaagaatcatgcttccatgaaagaaattataatcgtttatacaattgaatcgatttcagtattacaaaaactaagttgcatctattcgtatttagttcattaagaaggaaaacnaaac

SEQ ID NO: 101 - DNA, 398 bp, Homo sapiens
  Genbank Accession No. AA043959
  unsure (1)..(398): n = a or c or g or t
aagaatctaaagtgtggattttattccattgcacaatttgctagtgtatttcctgggtagtgtggtgctgaataaataggagtnnnnnnntggggtggggtgggtaagggattcagataagccagaagcagggtgatttttagttggaattgtaaactttagtcagcccccacacgctgctggggaatgtggaatgttctagctctgagatgttaactgagaaaagagaagtcaaacaaagccgatacgtgcagccctgtctacagaatccttcattatccagtttaatcaggagtttcttggtcttttattaacttggtcccaaagaaggaattcaagtcctagataagtaaatcctcaatttgctgttccctgaagtatggaaatgaagttgggcc

SEQ ID NO: 102 - DNA, 441 bp, Homo sapiens
  Genbank Accession No. AA044095
  unsure (1)..(441): n = a or c or g or t
gttttggaatctgctgtgggtccttccctgttgaccatttggtaacttataatctgacaaaaactcttgagctgcaacaggccttgcagagggctcaggatnngaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccantcctcattggttaaaggcacaccgtgagactttcagtgggctctgcttgagaaggaaggcagcccaggagtcaggtatgcaggcattgcattgtcagtgtctgctctcagagtttacacattcaattgcttccaagg

SEQ ID NO: 103 - DNA, 538 bp, Homo sapiens
  Genbank Accession No. AA044622
  unsure (1)..(538): n = a or c or g or t
ttttgaaacagagttccactcttgttgcccaggctggaatgtaggggaccccatctcagaggagtaggagagatacaggccaaaaagcagagagctacaagggagagaacaatcatgaaggaaaagccagttaggtgaatggttttcagtgaaggatgggacgtgaacacggggccctgtgtgctggagcttcagaaaatggggtcaacccccaggcaccttttcagattcctgcctcctccccacagccctctgtgcccctacctctgctttttacctaaggcagaactttgttttcctcaaacgcccacttcctttccttatcccccaaatacacaaaccttgcctcttcctctccagggaaacgctgaccagtttgtgtgaacgccatcacccacactcttgaaatatatctggaaagtgccggaagtgaactgggggatccttgcntccaaaacagggatgggctctgaacgccccaccacggctgtgcacgcggcctctggtgaggaancgtggtcacgatggcttcagggcg

SEQ ID NO: 104 - DNA, 479 bp, Homo sapiens
  Genbank Accession No. AA044755
ggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttataaaaa

SEQ ID NO: 105 - DNA, 507 bp, Homo sapiens
  Genbank Accession No. AA044842
aaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgcaaaaaaaaaaaaaaaaaaag

SEQ ID NO: 106 - DNA, 174 bp, Homo sapiens
  Genbank Accession No. AA045365
tttttttttttttattttactgcaaagaatattttattttatacatcactagccatgaatttttgccattagttactatacaaatgctgcctagtgccattatccaaatagcacaaccattttacgtccacaattcacttctatagttacaagtagaatttttcacggagtttc

SEQ ID NO: 107 - DNA, 428 bp, Homo sapiens
  Genbank Accession No. AA045481
  unsure (1)..(428): n = a or c or g or t
tttttttcagtaatacagatgtctattttattaaaaaagttacaaacaggtggactgcagggtcgtcttacaaaatgacaagaatgaaatctattggaaaaattttacttttacaaatctttataggtaattgttcaatgtttgtacttgttatttgagattttacctttcactgataaagttacagtacattagatccatgataataggttacattattttatttgcagagccctactgcagtgatttgaacaactcctaaatagatgccataataaagacaagacatatattgcatttaatattaatttattatcctaataagcaacatgcaatctattgaggaagctaaaataacttttggtcccctttcttaaaatgtgctggagaaaccacccttaaaatcactttcccccggattccngcga

SEQ ID NO: 108 - DNA, 397 bp, Homo sapiens
  Genbank Accession No. AA045870
  unsure (1)..(397): n = a or c or g or t
gtttagagtctaaaactaaaacctaatcatttngtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgnccccctcatttcccaaatgtttaaantgtattnggatttgggattctcaaatggtataagttggcct

SEQ ID NO: 109 - DNA, 383 bp, Homo sapiens
  Genbank Accession No. AA046103
gtcttgcaactgcaattttattttcttttgtgaaaataaacaactgggagtttaaattgctccaaaaaccataaaaacaaaaagaaatacacacagaagaagcatgtgaggtgatggggaagggaacagggtctctagaactttggcagattgtgctggcacggacccaggtgacaggagccagaccatggggctggtcccgcctgccactctgggattgtgaagggatgatcgccactggcaaggacggggaggaacacagacttcttcgctgaggaagtggcaggcaccttgagtccctttaaatgcgggggttgggaggaaaccatttcagaggaccgctttctccactgaaagctggggctggcgagttcgggcccact

SEQ ID NO: 110 - DNA, 509 bp, Homo sapiens
  Genbank Accession No. AA046410
  unsure (1)..(509): n = a or c or g or t
tttttttttttttaagtcacaggcgcatttattattgtctggaacatcaaggcctttcctcccctggcagtggcacaagggagggccaactctcagnaggcggccagtgccaccagcagcaggcccaatgggtgggcaggggtcnatgngcgggnaaaaanannncctnnagctngccgaaaagctggcgatntcaggatcctgggcttcgtaggacttgaccaagcgagcaaacttaaggacaccttccccgtcgcagctgaagccataggtttgataacctcctgctggatctgcgtggccacgggcagcacgaattgcagcatcttacccatgtcgttgcaggcgttatcccgagcctcgtccatgcgcactgcattctccggggcggaaaacgctggatcacctccgcgagaccacctttgcttgctcaacgctcaaggccgccggttggggngaagcggaccataaggggctgaaantctangttcnacggagggtaaatggga

SEQ ID NO: 111 - DNA, 475 bp, Homo sapiens
  Genbank Accession No. AA046457
  unsure (1)..(475): n = a or c or g or t
tntggtaaaaggtcaaggtctcaaaatgctaaatgatgagggaaagtgtagcaagtatgattcaattctattaaaagacagaanaatcaaggtaggcacttgctcaaaactacgtgagtagtcagagaggagacacaaattagctttgggaactcccgagaactccaatgtgctccagtcaaaatcttttttaaaaggttcctttgtaaacattacccttcccccgatctctgtgaccaaggttgccacctgtgacatggatttgcagcctgcagtattgtacttcccctgcttggggccatctgtgctaggacatgatgatttttctatgaaagcagctgttctcaccatcacaaccagccttgaattggtggcacaacctggatccaaatagtggctctggagcaactgggaatagggcccggggaccatccacccaggtggcagcgctgggctnaagcaaaggggagtcagg

SEQ ID NO: 112 - DNA, 550 bp, Homo sapiens
  Genbank Accession No. AA046674
  unsure (1)..(550): n = a or c or g or t
taaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtcacaggaaaaacctgactagtgaggaggagcagctgagagatagggncagtgaatccg

SEQ ID NO: 113 - DNA, 587 bp, Homo sapiens
  Genbank Accession No. AA046745
  unsure (1)..(587): n = a or c or g or t
ttttttttttgatttgtgaaataggtttagcaaaaatatattgagaataaaaatcagaaactggtaaagaaaagccaaatgaaaaaaatatacaaagttatcccccaaatgttgataagaacctagcgagttcagaagataggcccaggtgagaagtaggcccaacccggccaggcctcgaaagtgctccgcgtaaactacacgttgaaagtggacgtgttattggcatttcattcaaatccatgaggagaaaaaactacgggaggaaatcttacaacaccattgctgccaccacctgcagggccagcttctcactaggatggaaaagaagcgtttctgaggaacaattcacattagtacaaaaaaatgatacagccatttccaaagagcagagtaatgatcacaatggcagtttcgaggaatccagggtcagtcctcacacgggcctcacccagcctctcccgagtggcgacggcgctgagagccagaaagggggcacgcgaagacgagttttngcgacctttggaaagcctacgtacacattcagaggggttaaacattcctttgccattactttcctcggccga

SEQ ID NO: 114 - DNA, 516 bp, Homo sapiens
  Genbank Accession No. AA046747
tttttttttttttttcagcaaatgtttgttgaattttattactttttaaacaaattactgagtaatcttccttagtaatcatttctgtaactcagataaaaatagaaatttataagagtttttatttttgttacttgtaaaagtatatttcctagagaaaatatcagcagtggtagagaccagaaaaagtaagtgtgtgtgttctaaacagtgattccaactcaatgtgttcagagaaaacactttgaccctgtctgtgtttacagtccctgctgactgtgtactgtcgtatcctcagccttgttctatttctttattttagctttacagagattaggtctcaagttatgagaatctccatggctttcaggggctaaacttttctgccattcttttgctcttaccgggctcagaaggacatgtcaggtgggaaacgtgtttctctttcagagctgaagaaagggtctgagctgcggaatcagtagagaaagccttggtctcagtgactccttggct

SEQ ID NO: 115 - DNA, 560 bp, Homo sapiens
  Genbank Accession No. AA046840
  unsure (1)..(560): n = a or c or g or t
tacaaatactgtaaaaattaatataaaaaagtgagcatgctcagtcttttcctcttatctacaatacaaagggtttgtctgaaaagtctggttttttttctttttacaaatgtaccttagctgcatcaacaggagtaagatgtagaaaaagctaccattacaaaaataatttaagggaaaataaacacgtttagcttctctcgcagtttagtggtggtaagtccaggctgtagcttctttgcgctcctatgtcccaagaaactgcagcgggcacccggcggctctggctgcgcagggcagggcgcgctccgctccgggccgtcgggtctgaggtatgggtcgttgctgagtctctcccgccccggccgcgcgttaccggcagtctgctgtcccggcggccggcagaagggcgggctgggcagctgcttgaagaactgccggagggccaggtcccgcgtgantgctccacgcgctggtgcagttctcgtttcagcgacagctcacaactttgtgcantcctggttgcgccgcttggcttgtggggtttgcnacgggatgtt

SEQ ID NO: 116 - DNA, 464 bp, Homo sapiens
  Genbank Accession No. AA047151
  unsure (1)..(464): n = a or c or g or t
agaaaaaccaccatcgtgtcacgtcgacgatgccaaattatgttagcgtgacaganaacaccgtgggggaggaaggcagcagctgaagaaaaaagctcaaatgatctagtcactttcgatactgtacttcagatgcgaaatggatattcngagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaaggccgaacatttcatgtttggccgggcatgtgagtgcacaagatggaaagagcgattggagcatcctggtataattacccccattgtgctcttaatggaaatttcaaaggacgggagtattctgttggttggtgtccaggtttgtggcactgttccaagag

SEQ ID NO: 117 - DNA, 393 bp, Homo sapiens
  Genbank Accession No. AA047187
cagggtaaaaagcccaaccattactttactttaatagaggacagctactggtgttaaatacatttattgtaaactttagacacaaaaataggttctctaggccattcacatgcacattaaaaccaacaggtgcaaactacaacaatgcatataattatacaaatgatgccactctgtgatgtttacaggattgctgtccatgcaaggtgatcataggcattatttatgaagccttaagatccagaagtgttgttactaccaaacctctgattaacactgtgaagtaagtgttttggaaggcagttccatgagttgggctaacatttctttaaagcaaatgactgcttctaagcttagccgtacaagagattttggttgaactgaaaatattag

SEQ ID NO: 118 - DNA, 413 bp, Homo sapiens
  Genbank Accession No. AA047290
ataggtaaaatttttatttatgaatgtgtggacacatgactttggatccagccagccagtgacataaataaacttgagcaaaagtttcaagctagaggatatatatgtatagaaaattatatatttgtgtgtgtgtgtaaggcctcttggaacagtgccacaaacctggacaccaaccaacagaatactcccgtcctttgaaatttccattaagagcacaatgggggtaattataccaggatgctccaatcgctctttccatcttgtgcactcacatgcccgccaaacatgaaatgttcgccttctcccttccaatgtgatggttgttgaacttatctttagtgtcatttgataagcctttgtgctcacagagagacatcccactgacccagccactgggtcattggtctata

SEQ ID NO: 119 - DNA, 210 bp, Homo sapiens
  Genbank Accession No. AA047379
cagtttccaaatggttattttatcagattgtttgaacatttaattatcctgtttgcaatccaaaatagttacctgaagtttgctgttttgtgtgtatgtgtttacttttattgtatatttatttttctaaactctttggcacaattttctgggggcgttcagactgccacaatacaagtcaggagagggcgttttctttgtgcggccaaa

SEQ ID NO: 120 - DNA, 315 bp, Homo sapiens
  Genbank Accession No. AA047704
aatgtcaaggcaccacagattaaatatccttttatttgactcaaactgaacaataacatttaaaacacacaatgggaagcagcgcagttatctctcaaaatagacaatgatggttttttaagaggttgataaagcatatgtagaaaagtcagaatgtcaaaataagtaccaaggagaacatatactttgaaaagggggctaaaacatgtagctatacaatctggggttcttatcgattgatggataagattgattgagacagagtcttgctctgttgcccaggctggagtgcaatggcggtgatatcagctcacc

SEQ ID NO: 121 - DNA, 118 bp, Homo sapiens
  Genbank Accession No. AA052941
ttaattctggggaaacttttatttttatttctagaccaattgactatgggataggaaagaaagtgaggtgtcaaggataaagccaatatttgactcaaacaatgtagaggatgttttg

SEQ ID NO: 122 - DNA, 327 bp, Homo sapiens
  Genbank Accession No. AA052980
  unsure (1)..(327): n = a or c or g or t
tttttttttttttttttttttttttttttttttgtttcacaatatatttaatacaaaatggcagcagcactgtgcagttataacaaaattagccatagggtatctggagaaatgtacacaggcagcctcagctggagtcatgcgagccaactccggcctgctcgggtagggcctgtgcctgctgcccagtcagctgtgggtggtcacacggccaggactggatggtgcccgtgnaagggcggtgcacaagggctcagaggtgctgtacaggaggagccagtcttccaacagtacacaaaagcacgctgtcctcttgctctgcccccc

SEQ ID NO: 123 - DNA, 117 bp, Homo sapiens
  Genbank Accession No. AA053007
gaaattctcataattttaatgatcaatagcttctggtgggctctggatggtacagttaaacaatagacttaaagacctcccccaaagcacgtccacaccccctcggcagcgtctggc

SEQ ID NO: 124 - DNA, 115 bp, Homo sapiens
  Genbank Accession No. AA053033
aaaatgtggaactagtattcattttttattcaaatattttataaattatcatattggaggccctatagtgtggtagtttacagcatgaactctgtattccaagtgctcacgttcc

SEQ ID NO: 125 - DNA, 392 bp, Homo sapiens
  Genbank Accession No. AA053102
  unsure (1)..(392): n = a or c or g or t
gactacaaccagtgtttattcttgatttgtcaccactcttttcatagtcttgttttcttccacatgttaaatatataataaccaaaactttactaacatacgaatgaagaaaacatgcgcaagtantngcatggcaggtagtgaggaaatctggccagccgactggttcctttaccaaggtttgcagagtaggttgtgtttgaacaccttctgtgggtctgtgtcatttccaagttgaagaatttcagccaaagagcaacatgtcacattgattaaagatggttaatgacacagaaacatttctgttaatactaagggaaaaggctgttcttttatttatttatttttcctgagtcctcacgtttttcttctctgacaaatgtttgaaattc

SEQ ID NO: 126 - DNA, 327 bp, Homo sapiens
  Genbank Accession No. AA053248
  unsure (1)..(327): n = a or c or g or t
aagtttttttgctgtaagtttattcaatgcaaaataatcctctccaattttactgaggtggctgaccacatcctcaaccaaatccacctctaaactggaattcggttgctgacccagccccagcctcagctttgctgtncggcaccaggcggcacagcactccgtctgtaggttatctctgtccgctttccctcttgtgagtcttgcgggtcgtcacccttcagacctttaggctgaggacttccagtctctggacggctgcagatagagtggcaggcacaatctccggggcagatgaaggtaattcaacgggangaatcnttcgat

SEQ ID NO: 127 - DNA, 431 bp, Homo sapiens
  Genbank Accession No. AA053424
  unsure (1)..(431): n = a or c or g or t
tttgagctttcagatttgcttttattggtagggaaattccagagtggggagccacccaggaggagacaggggtgccgaggcttctgggagtctggaagctcccggatggagaggcttacagccccagccttccccagcaggagcacaggcaggggactggccaagtctgtcagctcagagcaggaccggcttcagggcctgacttcggtctcctcttgacccgccccggaggcttgtggtgggctctgtgtttgcagctctcctgaacagagctagatgagggtgggaggcccccgttggctcacacagtggatgctaccatctccggcctcttggatgtggagctctgtgccagagtcaacagtctccagggtgggccggaagttgttgtaggcgntctcaaggccgaaatctgctcttcctcagattct

SEQ ID NO: 128 - DNA, 427 bp, Homo sapiens
  Genbank Accession No. AA053660
  unsure (1)..(427): n = a or c or g or t
atctaacaaaggcactttattgcattaccattcacaattaacagtcaagaacaaataataataacaaataaaataacttttaagaggacaaggcattagaaataaaaaaggacactaataacatttgtaaaagcttgtactggatgtggttgcccccatttgtgtgtgtggttgtgtgtgtgtggttgtgtgttggtggccacagctgagcctctgtcaccagagaaggctgaggcccaatggcacacctcagaaacctacaccccgaggctnggacggctggactcctgagcacaagctccctctcgcaccctttgccagacagtttgtctccaatttcaaactgacctaaggctcttactcctggattttttgtttttaaaccttctcccagccagtcttcgggagggcatgattagagaagngg

SEQ ID NO: 129 - DNA, 368 bp, Homo sapiens
  Genbank Accession No. AA053662
atgtgcattatttttttcaagcagctaccttgttaggacatacttaatagttatcttggcctacctactgcacttactaaacaactgttcactttttaatttttaattttcagatttttttgagacggattgttactctatcgcccaggctggagtgcagtggcgtgatctctgctcactgcaacctccgcctcccgggttcaagctattctcctgcctcagcctcctgagtatctgggactacaggtgtgcgccaccacatccagctaatttttgtatttttagtagagatggggttttaccatgttggccaggctgatctggaactcctgacctcaggtgatccacctgcctcggtctcccaaagc

SEQ ID NO: 130 - DNA, 446 bp, Homo sapiens
  Genbank Accession No. AA053680
ggaagtggcaggggaggtgctgctgctccagcgtatgggatgctgggaggagggccagatgtcactgtgacctctcccactggcacggcagaaagtcctaaacttctcttggacttggagtgtcgcttctctttatgcttctccttgtctttcttctttttgctcttctttgacttctttttcttcttgatttctcggtaagaatcatctatcactaactccccagcctctagttccccaccagaggatgagtctgattctaccagaataggttcaagccctgaaagatcaaggttagcactgtgggactctgcgaactgggaggcgtcagacccacagccttcagggccaggagatgaatgtgcgtctgaggatgacttgtgctttttccgggctgttttcagaaagctctgtaactcatgtcctaggagtaaagcaccctgctc

SEQ ID NO: 131 - DNA, 444 bp, Homo sapiens
  Genbank Accession No. AA053917
cagagcagagggtttttctatttattacaaaagttgttacacaaatacagctgaccagaaggtctaaaaacagcccagactcttccaaccctcatgcatctgtagatagaaggagagctgtggtcttgctcacacacaggggagcccttcttagaagaactgcctgtcccttggaaggttcagagtcttgggtccagcagcagagaggagcccaacctgcgtggacaaccccttgaggcagcccttggtcacagctgctctgggtgggcagcaggtttaagtttcatagttcacatgttcccaccacacaagtcaaatcaaggcatgaaaataaaagggaaaaaggggaaggctggaaaagggagcctggaagaggttgcaggtaggggaaggagacacagtgggcttccgagaagctggcaatttcttgacttggatggagtt

SEQ ID NO: 132 - DNA, 190 bp, Homo sapiens
  Genbank Accession No. AA055805
ttttttccacgttcagtcgcagtttattaaagttagaagtgtctccatccaccccctacagaggcttgcgtggtggttccagtctgctaaatatttcagaatggggacctcattctatctactgatttatcaaatctcattaattaatttcccttgctgatatgaggggttgggagagaagggggacgtt

SEQ ID NO: 133 - DNA, 337 bp, Homo sapiens
  Genbank Accession No. AA055811
  unsure (1)..(337): n = a or c or g or t
ttaagaatttccacccacaattttattattactgaaagcatttggaatgaagcaaaggatttaacaatatatataaaaatatacattttttaaaaaatcgcaagtagacaatagatttatggaattatttttctgatcatccagaaaagatagcaatagtaaactgcagttgggtngagaccagccactgngtccatgagacctaagcagccctaacgctgcctgagctctcaagagtagaagaaatgctcgacaaacagaaggaggctgtgggagggcagcaggacagccccaccagaaaaccagagcccaaatgggntggggcagggccaggggc

SEQ ID NO: 134 - DNA, 456 bp, Homo sapiens
  Genbank Accession No. AA055892
  unsure (1)..(456): n = a or c or g or t
tttttttttttttttttaatagaacaggtcaagataaggctttatttctatagaaatgatgctttgacaatagtttggcttggtgtaaggctcacaaaagaaaatcacatgtaccatgtgtgggttaagcggtttgattcacactgaaccaggccagcccagttgccctctgctgtgtccacccgtggagtggagctgtgtcacagccatcacactggtaaactgctgtagctggtttaccaggctttctcttgccctgacagtacaggtgaagcctgtaaataaatcttctgctatctttgtgaacttaaccaaatcccagttaccttatttaaatggcaatagatctgttttcccttaaactagaaaccttaattacctgtattcctacctccagctcaacccatatatttgcanctttccagtaagcaggttttgtattttccatcgccccct

SEQ ID NO: 135 - DNA, 272 bp, Homo sapiens
  Genbank Accession No. AA055896
tttttgcaaatataagaagtaattttattgcaatatactgtggctagagtggtctggggagaacgggacacattttgaagttcagtacaaattataacaactttgaagggaccacagaggaagaaaatgacaggagaaaaggacaaattggatgggatgagaaatgaaaacagaatcacatgacctagacgcagccacgggggtcgcgggacagtcctcggctatggcttttcttttgaagagatgaaggtgacagtcattggcacatgcta

SEQ ID NO: 136 - DNA, 441 bp, Homo sapiens
  Genbank Accession No. AA055992
  unsure (1)..(441): n = a or c or g or t
ggtttgtttcctttaattaaatctcaaatttacaagagtccagactgtctggacagcccaacagggacacagagagttttacacactgatgtctcaacagcacagggttccatcgggacttcgtgagaaaatcaggatccatgtacgttcttgaagagctgtctctcggcctaagataagtggagaaggttgccttggaagcgtggggtagaggtaggaacagctggctctctggccaaggctttgnttttttcgcggaacaaaaacccgacccacgggaaagggctgctccgagtctgggggtcagaaatttcctatcagtngagtgcagcaggccagggagaggcgaaagggagtgggagaggactgtgggcgaaagggagaggggcggcccctgcacagcttcaccaggcgtcagtgcaggctcagacggccggactg

SEQ ID NO: 137 - DNA, 531 bp, Homo sapiens
  Genbank Accession No. AA056170
  unsure (1)..(531): n = a or c or g or t
gctctttattcgtgagttttccatttacctccgctgaacctagagcttcagacgccctatgggtncgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatgnttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcacgtggccgcctcctgagagttggccctcccttgtgccactgccaggggaggaaaggccttgatgttccagacaataataaatgcgcctgtgacttaaaaaaaaaaaanagg

SEQ ID NO: 138 - DNA, 462 bp, Homo sapiens
  Genbank Accession No. AA056247
  unsure (1)..(462): n = a or c or g or t
ttttttttaaacaggaatgaatcatttattcaaacaaaacaaaaagctatataattttgagaatttcattttttgagagtaaaaactacaaaattgaacagcgaggaggaaaaaattctgacaatgtgattcaacattaatcctttaaaagtcactgtaacaaatttaaacataagtgctttatttttctattcacaaaactaattataatacaccacaatgaattttgttacggttttatgtgtgtaatagagggtatacatctccatactactagctaatttgtctgtttgttcaaaagagttatttttctctttttttcttctttgagacagggtctcacgctcttgcccaggctatagcatnaagggcacatcacagctcactgcagccacaacctcctggggctcaaccgatcctccntgtctcagccttcaagtagcctggactacaggcacacat

SEQ ID NO: 139 - DNA, 394 bp, Homo sapiens
  Genbank Accession No. AA056319
  unsure (1)..(394): n = a or c or g or t
gccaggttttgtttgtttttttacaaagttaccgagatgacaatatccataattagctgactcttacgtacacactgtgacctgatcatcctgaaaaactttatgggggagaaaggtcagcagcttctctttctttttcttgaaaataataaaactgcgtattctactttatatttaaatgtaaggaagaaaatatacaagcccatatttatattgtatttctattaagagcaacaatagttcatatgttcatgtttgctactatcacaattcaacatatgaacacagatcagctctataccatgaatactgctggaagtgatggtttaggattaccaacctcactgctgcatgaccaanacaaagcaaatgccatccctgggaaataaaccct

SEQ ID NO: 140 - DNA, 498 bp, Homo sapiens
  Genbank Accession No. AA056361
gaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaaaaaa

SEQ ID NO: 141 - DNA, 507 bp, Homo sapiens
  Genbank Accession No. AA056482
accatcaacttattttgtattctataacatacaagactgtaaagatgtgacagtgtacattatatgacaatgcacattagccagcaagtcttttataggtggtttcagcagcaacgataagtaatgcagaattcagctccagcactttatttcaaaagaaatttcctgcctccctccaagatgcagggtgaggaggtagcttggggttgctattggagaagtattcagtttgctactttgtgtcaccccttgccattcttttatccccagttaattattatctgcatataatataaatctgctagaccataaattaacagctttcaggacagatgccttgaaagttcttagggaggttaaacaaatattgtagcctaaaacctcctctataacaaacatgcacacaatgggaagtgatgtcgtaagtgagtgatggggcaggaaggacctagggctctgtctcgactataaatcaccctggcccccaaccaatttaaattattacct

SEQ ID NO: 142 - DNA, 388 bp, Homo sapiens
  Genbank Accession No. AA056735
  unsure (1)..(388): n = a or c or g or t
aagattatacgaangatttattgatactggttaacatccattatatacaggtagaaactttcaaaattgtacaaagaaccattaagcatattgataaagacagttttacagacaaaacaactggaaaatagttttaacatacacaatatataattatgaaaaaaatgtagaacacatattgttctaccagataaatcccaaggttattaaaagtctgctatgcagacctttaagttgaaaaatgtgttcaatggagttacatggttttagaaaattaagtataatgttaaaattaagcttttttttctcattgcaatttgggagaggaactgagacaacttttttaccccaaatctatacagtttgaaaaataatttatatgtctagc

SEQ ID NO: 143 - DNA, 491 bp, Homo sapiens
  Genbank Accession No. AA057678
  unsure (1)..(491): n = a or c or g or t
ggtagttctatttcataaagaaaaaaatcatttactggaatgagctaaaatgctagagagaaatccacagcaataattatccaaatatatgaacaatcccatcttcaaagatcattattccaacattctctgaggtgcaactaataattgctaacttggctgtgactttacagtgcctgtcaatgtgatttcaaggatcccataagctatctaatcacagtggatgcacagtacatgtgatgtgatcagatgaaggtttgatcatgaactcnattaaaaaactgnaatataagagagaaggaaactgatggggaaacactcaagagctttggcaagattagaaaggttaaaggcaggatggggaagaaaagcnaggacatctaagagtacagagagaaacctaatccaaggttaccagtacataccaccaatactgccatggggaggaaggttcccgctggtaatttgggacagaccggcacccttaagcc

SEQ ID NO: 144 - DNA, 517 bp, Homo sapiens
  Genbank Accession No. AA058589
  unsure (1)..(517): n = a or c or g or t
tttttttctgtaaaagcatttcctctgaatattttattcagaaaaaaaacacaaaaagataaggcagaaacaaaaatcccagtcatttgcagtatctgttggctttcaatttggtcctcttgtttaaacaaagaaaaatagtaaaattaatctatgtaaaacatgccatatatattcaactgctactaaatataaaaagctataaaactgtgtgttcaattttggttactgtattatcacaacacttatattaaaatatgtatacttttaaatttggtttctataaaaaatggattctaatcccataaaagttatttcctaatattcaataaatgttgcctaagggntttttctntccaaatagcaattttattccggaatttaagggtgctcnaaatttccatttaacagggtgagaatgctgnattattaccagtgagnaaagttaccggnctagagtttattccgtttagagtcccatccngatanaatttgaacccctcctgnttcttacaac

SEQ ID NO: 145 - DNA, 607 bp, Homo sapiens
  Genbank Accession No. AA059489
  unsure (1)..(607): n = a or c or g or t
caaattttatttgtatacaaaaatatattataatgngaaagcttactgctatttccaactatatataattaattacaaatattttcataaaagcactttaaattacaggaaagctatgttttaagagaaaatacaatattagcatggatcgtctgttctaatatgctgcaagaggtaaacaaagtcagtttcactgtctaaattgcccagaaatgggatcaagggctgattttaaggtgagcctgagagtggcctggtagaaggttnagtgcacgtctttgtcccctctggcagcagattctagtagctgattttagcaggtcctcggaactttctgaagcttctcccttatgatgaaaggacccagaacttcttgtttcacatacttgctaaagttttgtcaagatcagcaatgaaggcttctagctcnttngtgtctcctaatttagctttctgaggagtgacagtggcagagagaagagctggggtagagtctgttggagaattcagnttttcatcactgaagctgagctgttcctataaagtgaatntgcactctccgagtcgctgaagccgctgttgtcgctgcgcttggctgctcgcnttc

SEQ ID NO: 146 - DNA, 457 bp, Homo sapiens
  Genbank Accession No. AA062721
  unsure (1)..(457): n = a or c or g or t
ttttttttatgccaaatcccattcccaagatgactatattttatagtttattatgaggtaactgcctccagacagataagcccctgcatgatgctgaaagtcagagcctgggggtgaatgccaccttatctttgtcctcctcagctggtctgcgtgtctctgctcagaacgctgtgtagtagtgctccattgtgctgacaatgtcactctggtcctccaggagctccagaacttgctgcagcacagcctcgctcaggcccgggcggatnctcaggcgagcacaggccaagatgtgcaggaagtgacagcccttctccatgtgatttggtttctggcagtcctgctgaatgatccggtggatctttctgtgcaggtctttgtcttctctggttacatagtataggttatcaaaaccatcatctttctggaaaacaagtcctttttcctgcagcagttg

SEQ ID NO: 147 - DNA, 504 bp, Homo sapiens
  Genbank Accession No. AA062744
  unsure (1)..(504): n = a or c or g or t
ccttccatcttttttccctttgctcaggcacctgcacagcagctcaggaccactcagtggtggctccaacccactcagtggcctgcgctgtgggagctgctgaccaatcctcagtggctggctgtgcactccagtcttccgtggggaactgctggatgggcacagagggaacctgcacaccctcagaccagtcggccacctcaggctgagcagcagtgaactcaggagctggtgcggtccattcaccctggaattcctccttggtcacagccttctcagcagcagcctgctcctccttctcaatctcctctgggtctctgtangaagtaaagatcaggcatgacctcccaggggtgctcacgggagatagtacctcgcatgcggagtacttccctggccagcatccaccacatcagacccactgagtgagctcccttgttgttgcatgggatggcaatgtccacatagcgcaggggagaatctgtgttacacagagcaatggta

SEQ ID NO: 148 - DNA, 333 bp, Homo sapiens
  Genbank Accession No. AA065173
  unsure (1)..(333): n = a or c or g or t
ntttttcatgaagaccagtttattttacatgcttgctttcacattctttactgggaatttaaggccttttttcagccttaacttgtataccaacctcaaggattttgtttgatacagaaaaggatagggctgggccttctgccaaggactgataacctgcctgccaaaaggaagagggaatgaaagccttttgtccttctaggccccttacagtacctcaaaatctaaaggccttaaaggggaaaaaaaccgtatctgttctttctccttatctcctacccttctctttaagcatattgaagatggacttttttccaaatgtttatttgtagg

SEQ ID NO: 149 - DNA, 267 bp, Homo sapiens
  Genbank Accession No. AA069456
  unsure (1)..(267): n = a or c or g or t
accgagtatattctgtttattgtttatgatttacacagaaaatgatgggctggggttatagaacaataaaccaaccattacatttagacctgggcttttgaaaaacttgcattccattttaacaattcgtatgtatctaacaaatacataaatccagatcacaaataatcttaagagttaaacaattaagaaacacaaagaataccacatagatctacctttaaatatcagcattcatattataagagataagaaaatgttanaaag

SEQ ID NO: 150 - DNA, 427 bp, Homo sapiens
  Genbank Accession No. AA069696
attcacagcatacttttatttaccaaagtacatcgtacattatacaaatcttaattacatttacattatacatttataatattaaaattgtgcgagtagtcttcaaatatctgacaactttggggtcagtgaattatttaagaaaaaaactcagaagagttttgaaaaaggagcaggtgtgattctacaaattcaatatgaggcaccagtgggagaagtcaattggatgagcacatgaaatattaggagtgctcgtgagggggaagtaacaggtctattgtgtgcagtgctgggcaggctgcatatggagaatgtgttaaaagagcatttgcaaacttaagcattacttgaagatattaaacagaatgatggaagcctggtctttgattatttattgctgacatatgcattgcagtgatggcattaa

SEQ ID NO: 151 - DNA, 519 bp, Homo sapiens
  Genbank Accession No. AA069768
  unsure (1)..(519): n = a or c or g or t
aaccacanaagagtagcagtccattttctggaagngcgcatgatattatgancaatacaaatgcattatttttatcattaatagtntaatcattaattatcncanaagtcaatgcagagagtgaaattantntgaattaaacttcngttcanaatgtacagtattttgcatatgtngactttacttaatngtncattnttgtttccaaagttaangttaaatacctggtgcataggttgttgtcaagcaattactctcattgtcttgtcatacatgctaacattttgctaaatataaatctacaagtatcacagctgcatatatttctgaagtggttagaacagaggaggatgctggaaagttgagttctttaaaatcttcgttcaaaacaagagattttcatctatgtcctcttctttaattccaaagcagtggncccactccttcagggtgatgtgcttatccttnttggggtcacactccntcaaataaacgggttatgccagtgttccatgggcc

SEQ ID NO: 152 - DNA, 396 bp, Homo sapiens
  Genbank Accession No. AA070090
ggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaaggctgattcgggtgaagactgcaggagctagccgaattcgaaaaactcttcggatcaggtgaaagatcagttgaagaagcccttgagagcagattggcttttggagacaatcctttctatcactgtttggtagcagagattcttccaagcgcccgggaaagctacttgggggcc

SEQ ID NO: 153 - DNA, 417 bp, Homo sapiens
  Genbank Accession No. AA070091
  unsure (1)..(417): n = a or c or g or t
ttcaggacatgtaattcttatttatttttcaccctcaacaaggaagaaaggtctctccctcaattctgctcttccaatacttgaggataggcacccctaaccctccttcctccagggaggcctcagcatcagtgtctgtggacgtanctctgaagagtgcttcagctgatggggaaggagaaactcaagacagagatcctcctagggatggcgtcactttcctgccaactttctcgttgcctctccttgaaagcagaagaagtgccagccctcagcttccgtcagatcttgggctcctagggccttgtacaagtccatggccctctggttccagtccaggacggccaggcagaattgggagcagcccttatccaaggccaccttcagccacctttttgattattttggaaccaatcc

SEQ ID NO: 154 - DNA, 429 bp, Homo sapiens
  Genbank Accession No. AA070191
  unsure (1)..(429): n = a or c or g or t
tttaaaattaaaaagatatattttttaattaaaccctatctctattagtccacagttcttttctgcatcaaagccattgatcccaatttgacctgattaaatgtccctgaagcactgagggtaggacccagagtgctgtgggtgagaggagggagctttgtgtccctgggacccttgacaaggtgacaaaatgcctgactagaagcccgagtagncaagagacaggtgttcagattccttgagccagaaaaggtgagatgtgtttctgtccagggtggcaagaactggcctgctgtcctcacagcccagccactcaaaaggggcatctcccaagatgantcctaaatccagtcaaggtgacagtaaagactcggccaactgaagttcctggggagtggcctagacaagttttacaggacttaatctttc

SEQ ID NO: 155 - DNA, 353 bp, Homo sapiens
  Genbank Accession No. AA070206
  unsure (1)..(353): n = a or c or g or t
tttttttttttgaggcaaacagtctttattgggttcacaccaggagtccgttggtcttgaggacctctgtgaacttgcagattttcttctccacattcttttctgcctgtttccgtaacctcaagatctgcttcttcttccgatagtgcatcttggccttttccttccgtttctcctccagagtggctgtcactgcctggtacttccacccgacctcatgcgccagacgccccaggtaagcaaactttctggtaaggcttcagcgaaacaaccttgagagcagcaagggaccaccantccgctttttcttgncatagggtggagggattccattcaaaaactttgaangcgct

SEQ ID NO: 156 - DNA, 257 bp, Homo sapiens
  Genbank Accession No. AA070485
tttttttttttttttttttctttcaggtttggacttcttaaccatctttttgtttttctttttcgaactgccatagtcactatcgtcatcatcttccattaggaaatcttcatcgctgccggaatctttctcctggaatggtgcctcatcctcctcttcttgttcttcctcactgcccacatcttccatgagcatctctctctgtttagaagctgctttagatgccgcctgccgttgttggcgcacatttttatgat

SEQ ID NO: 157 - DNA, 463 bp, Homo sapiens
  Genbank Accession No. AA070827
ttgtgggcaaaccttgttttaattgcaaacgacttaatttacagcacattcaataatgaaccaacaggagagttgctgactttgtaacatatgaatatataaaaatcccttgcaattcaggtagtcaaggtaaaaagcgcatacaaggaaggcaatcctcatttttctgaaaatgtttacattttaaaaggtgactagacatacttggaagttcaaagcagtaggatgtagcttgcagggaaaagaaaacccttttccatgttgttaggcagaagtatatcaaatatatcccaattccacttgataaagtcagttggatgacctcctttgaaccaatctagggcagaacacttagtaaaagcgggccctgggtggggatgtgaatccaggagaagaggggcacagatcccatgcagcgccaaacacatccattccaccctctaacacatacgaggcatgtcac

SEQ ID NO: 158 - DNA, 363 bp, Homo sapiens
  Genbank Accession No. AA071387
ggggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatc

SEQ ID NO: 159 - DNA, 349 bp, Homo sapiens
  Genbank Accession No. AA074162
  unsure (1)..(349): n = a or c or g or t
tgctgttttatcatcatgtttttacatggggcattcactgggtgtagaggctggccgcaaatacgatgtcccgccgtagcaaggtagccgctgtctccatcttggcacccagcacaggctctcctaccaggcgggctngccccccgcagtgagcgacacatctnagccaggcgctgaatgcagcggaccaccaggccctcaggggtccctgagagccctgccaactcgnagaagggcatgcccggtgcccactcatatacaacctcaaccaggcccaaaattcagctcccccacaaattcctccacngtctggttnaggccacaagccaccttgggacctcancaatcc

SEQ ID NO: 160 - DNA, 330 bp, Homo sapiens
  Genbank Accession No. AA074514
  unsure (1)..(330): n = a or c or g or t
gtgtttactacaaactgtttaattgtttcttatcccaataactttacaaatatagaaccacatgctagtctgggggtgctgtgcagtgagtcactacaaactcgctcaggcacagcttaatgccgctgagatccatctaggagcagtcccagcggtggcctcagccagtngaggaagagggctttggaggagggctgccaagtgtggccaggggacccggcctcaggtctgtggaggtgcttcaacagcacgatgctcattctctgtccgtagtgtctccatatactttctcatcttctccaccatccaggagggtaggacaaaggattt

SEQ ID NO: 161 - DNA, 252 bp, Homo sapiens
  Genbank Accession No. AA074885
ttgccaatgatgttgagctttattaatggcccctctccagaggctgctcagttgtccccagggaactcctcagagatcctctgccttcccacatatgagcccgaggacacctcgggagcagagaagtgaaagggtttccgggtcagacgctgcactccacgcctgcgtcctcctcgtggctgcagtcatgatggccccagctattcttggtgcagctccacagggtactctccgtgccccgacactgaacaa

SEQ ID NO: 162 - DNA, 562 bp, Homo sapiens
  Genbank Accession No. AA074891
  unsure (1)..(562): n = a or c or g or t
ttcaacaatttccctttatttaatctccatattcatgtcccctaaatatatatatattttgattttgttaggagaaaggagatttgggattgggtattaacacacacagggtgcagaagaagcccactacaattgcttgccttggaaagtaggacctggtcccagatactcgccaggacatggctggcagctcctcaaggaggacaacaggctggcagctgcgtgagactatgtaagtaatggaagtcttggggtgcagaccattatagcaacccgtcgagattcttgtggacagtctggtttccctttccatcatcagaatccccttgaggtgtgtactgaacttggtattcctgaaggattttaaaaacatcatggtgtccaaagtgtagtgcttcatccatgggggtattattccacctgtccntggggaaagggtttacctttgcaagcttccagcaaaaacttgacaactttcaacatgaccctctgctgctgcgacatgggaaggctgttctggagtcatatcccgctgctccatgtccanggctgacaaagcaac

SEQ ID NO: 163 - DNA, 239 bp, Homo sapiens
  Genbank Accession No. AA075298
taatcaaagtaagcaataatgacaggtttattgaaaatttccagtagagaaaacccactagttttggaataaaagtactcaatgtacgagagcataagtgaatacaaaagattaacagaaggaaaataaaaccaaacatagtacaaaaaaatttaaaaagtttgaaatgaattcaaactgggatgttctttaaatcctccaaatatttaacagagttactaagtttggcaaaaaattca

SEQ ID NO: 164 - DNA, 328 bp, Homo sapiens
  Genbank Accession No. AA075299
  unsure (1)..(328): n = a or c or g or t
tttttttttttgtttaaaatcatttattattatcaggagtgccttttaggtggaccgctctgtatgactctcatgcttcaaaactattttttattcaagtgacttacaatggccctaggaaacaagttctgttattatcccccattttaaaatgatgaaaatggacaaagcaaaagcaagcaacttaaccaataccccatggcctcacagcctttagaatagtcatattatataaatatggcaataacaatgcnctgaaaatgtctccaaaacaaactctacattttaaaaaatgtataacaggaatctaaggaaggggtcttacttc

SEQ ID NO: 165 - DNA, 541 bp, Homo sapiens
  Genbank Accession No. AA075580
gtttattaggcagcagctgggaaatcagcggttagacttggccacacgctccagttcatctttcttcttgatggcataggaattggaggagcccttggagcattaatgagctcatctgcaaggcactcggcgatggtcttgatgttccggaaagcagcctcacgagcccctgtgcacagcagccagatggcctgattcactcgacgcagtggggacacatccacagcctgtcgtctcactgtaccggcccgcccaatgcgtgttgagtcttctcgggggccactgttgatgatagcattcaccaggacctgcagagggttctcaccagtgagcaggtggatgatctcaaaggcatgcttgacaattcgcacagtcatgagcttcttgccgttgttacgaccatgcatcatcatggagttagtaaggcgctccacgatgggacattgtgctttgcggaagcttggcagcataccgtccggcactgtggggcaggtacttggcatacttctccttcacagcaatgtaatcctgcagagaaata

SEQ ID NO: 166 - DNA, 609 bp, Homo sapiens
  Genbank Accession No. AA075722
  unsure (1)..(609): n = a or c or g or t
taactgttaagaaaatttttgtggttttattgtatcatgaggcattgaaacatctgaacaaatcaatatctgggcggttggtgaggcagctgctttctccttcacttctttgggttactagagcaacttgtcagtagattaaaaaaacaaaacaaaacaaaaaataaaacaaaaacaaaacccgacaatcgtttgcattacttaagtctttccaaggcatgcgctggtacaacacaaacttcctgtcagatgcgactagtctagcatccaaacatcatgcacaacaccgtggtgacagaagcgccctgcacccgctcccgcctcggccctgctcgtttgtgtatgatatttggagcatctggaggagtgagctaggattgggaagagggaggaggaaacagcgtgactgtggccaggaggaggtcagccgaagttgtgcagggcaagcctgaacatgtcattggtgcnaaccccaagcatcgttgatgttccttaatagaaacatctggtggaaaccctgatgggatcttcatcagccttgagctgggccacaccatgctgatgatgcagctatctggtgtaagctggtggtcctgcgccgtgatgcaa

SEQ ID NO: 167 - DNA, 430 bp, Homo sapiens
  Genbank Accession No. AA076138
  unsure (1)..(430): n = a or c or g or t
taaactgaaggtggggtacatggtgcagctggttctgtcattgctcagcctagttggcgtccagcttggccatttcctgcacatagatgcctatactctcgctgtcaaaaagcacgaagtacaccgttttgatggaagaggacattgtagacacgaagtaactggagatggccttcagaatcagctgagctgctgtctgctttggaaaaccgttcctgccgctgccgatggatggaaatgcaatggatttcagcttcttatcatcagccagggccaagcagtttttcactgtcttttccagaagttcttcacacttgtctgcaccccaaactggactattacagtggatcacaaacttggcaggcaggccatggcnggcttgacagcagctccagctacttccaagggcccgttctttttccggagttcc

SEQ ID NO: 168 - DNA, 451 bp, Homo sapiens
  Genbank Accession No. AA076238
  unsure (1)..(451): n = a or c or g or t
gacacggaggntcgcncttgttgcccaggctggagtgcaatggcgcaatctcgactcaccacaacctccgcctcccaggttcaagcgactctgctgcctcagccttcccgagtagctgggattacaggcatgtgccaccacgctgggctaattttgtatttttagtagagacagggcttctccacgttggtcaggctggtcttgaactaccgacctcaggtgatccacccacctcggcctcccaaagtgcttggatcacaagcatgagccactgcgcccagccataaatgtgtacttctaacataaaatttaatctgggctgaaacaaatatttggaccatagtaaaatgctttctctataatttgttccttcctttcttttttctagcaagcttcagagccaacagggcgcttctcctggaaggtgaagtcatggtgacctactgctctt

SEQ ID NO: 169 - DNA, 411 bp, Homo sapiens
  Genbank Accession No. AA076249
tgcgtgtgtgaccccagtgctgacgtttgaggaggccctccaccaccagcacaacagagaacgggcctccttcatcactgatggggagcagctcccgagcccccgccctgcacctctgctttccagaactcctgccgtcccatctgccaaaagggacccttctgtaggggagcacaccgtagaagtgcttagagagtatggattcagtcaggaagagatccttcatgctgcactcagatagaatcgttgaaaagtgataagctaaaagccaatctctgactcaggcttatagctcaagagaatctgaaggctgcatctccacttggggagggatgcccacaattgtgtgtatggaaatgtggatgaacagcaatgaagtcatccaaatatcccaatcacgatccaacgaaa

SEQ ID NO: 170 - DNA, 361 bp, Homo sapiens
  Genbank Accession No. AA076326
  unsure (1)..(361): n = a or c or g or t
tttgcgcactgaacgttgctttattcattggttaattttcctaacagcgttgtaaacccaggccgggatgtcctgagcgttctggcagaggcccgtgcagcctcggccccttccggtccgcgctanctggcctttgccctgagctccctcagcttcgcaagatgagcttcccagacggggccggggctgggctctgagggaaaggcgttcccgcaggtctggggccgccttcccatgttctctaaagcccagcacctgtggttcgttggcggggctcgtgggattggggtaagggctgtggtttcgaggccgtctgtggcgcccccagcccctaagtctgcgagacgccggccccgccttt

SEQ ID NO: 171 - DNA, 456 bp, Homo sapiens
  Genbank Accession No. AA076383
tttttttttttgtaagaatagtttttaatccattttctcacaagcagtgcacagtgggccggcagtacttaagtaccttatcctaatcctggatgtgctcatacaggctgtcaatttgggtccgaaagtatttggaaagctctcctcgctttgctttcaatgttggtgtcaagagcccattttcaatggaaaatggctctggatgaagaaaaatggctttgacctgttcaaaagttttaaggccactttctttcccaattttctgcaagtcttctaaaatggcttcccttacaacttggttttggcacagttcctcaaaggagcccttcaccccaagcttggctgcaaatgagggaagtacatctgtgtcaggaaccaccactcctactaaaggatgaccgtaagctctccccgtgtacaaaaatttggtaacactgggttgactcctgttgtaga

SEQ ID NO: 172 - DNA, 431 bp, Homo sapiens
  Genbank Accession No. AA076672
ttttactttgaacattagcattaagttggttaccgtacacatccaaaggcccagcatctcagaaaaatcattaggcggcacacctgtaccagagtctcacaagaataaaatatacaatgctacattgagtggttaaaaatacacaaaaaagtagttttaacaatctataaattttttatacttaaaatcatgattgagttgaaataaaaaagtgcatttcaattgctaaaaaaataatatcggtatagttaacacaagggggaaatcagtacattgagggatctgacaggatgctggaaaaaatgactcagggaagccgggcagcatgggctcctttggagattcaggagcggctcagtttccacctcactgcagttccctggggccaagcagccctcctctccccagtatctttcccatcttaagagatc

SEQ ID NO: 173 - DNA, 426 bp, Homo sapiens
  Genbank Accession No. AA078862
  unsure (1)..(417): n = a or c or g or t
agccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaaatgactttaattaacccaagagtttttaatttttggaantttgtaagctgtcggttcacntttttaacccacccattcaattaaaccnttacaggaattggcnaaaaaaaaaaaaa

SEQ ID NO: 174 - DNA, 382 bp, Homo sapiens
  Genbank Accession No. AA079758
  unsure (1)..(382): n = a or c or g or t
ggtggtcctgagagtggtgggtgccacctgtccggggcggagagagggcccgaggcagtntaaggccaatgngggagaagcagggggctgcagctgngcnatgcggtgaagccaggccgaggcctggagcagctgtggtaggccagggcagggtggaaggcaccggactgggaccgggccagggctacagggccgaggacccaggccacacgggcaccccgggaaggcggggcacaagggtcacgtgacacagaacatgaaacacaggcacagggttcacagtaagcacattggacaagtgggcacagggtcataggccagatgcacatccagccatggctggggccagacacttgggacacagtggtggtgtcacacacag

SEQ ID NO: 175 - DNA, 394 bp, Homo sapiens
  Genbank Accession No. AA083812
tacttttttttaaaagatttttttgtaaagaagggttgtatttagaggccagtagctagagatccaaccagtggacctcttgaagcactaccaggccttaaggcaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctccgatttggtcaa

SEQ ID NO: 176 - DNA, 408 bp, Homo sapiens
  Genbank Accession No. AA084286
tatttttaactttatttttattgttgacactattacagatagaatgaccacaaccatattaacaaaccaaaaacctgtgcacagaaacaagatgaagaaaatatatcaagatgttaaccacactctttggatggtgaaaacatgggtgagtttctcttctacatttctgtaacttcaaagtttctataatgaacacatttcatatataatggaaatatatgtagtaaaggtggactaccaaaacactagaatgatgacctttcaaggaaaccgaaacaaaataaccataatcccacaacaaccacacaactatttcttgtttttcatctttcttcccatctttgacatttatgcatacttatcactaacaccctaataatcacagactagtgcacagatcaagatgtt

SEQ ID NO: 177 - DNA, 390 bp, Homo sapiens
  Genbank Accession No. AA084318
ttttttttgaaaccaagttcatctttatttaaaggattgacaatcccattttaaacaattctttgatttacaaagagggaggtagactcgttagcctcccaaccttagcttaaatcgtgatgttgccaggttcctggtggttcagctgaatcctagacagtttcccttctcttcataaagctgagaagaaaaaaaaattatctccatctaggcccacgggaattttgtgcatagacagtttgaattggtctgaaaagtgtgactagctacctacctattcacaatgcctagaaaatgggctaccagatatggtagtggtcaaagccccgactttcctgtctgaggtacttgggtttgctctaaggtagaccttggcaagggcccctaatg

SEQ ID NO: 178 - DNA, 442 bp, Homo sapiens
  Genbank Accession No. AA084343
  unsure (1)..(442): n = a or c or g or t
tttttgctgcagaaagacctttactgggcagatgggggtgttgagataccagtggacagagtgagaggatagcatgtcctccagaggcgcgggggtagtgtccctgcctgggagcctaagcctgaatgcactaagggctggcaccacagacgggctcaggggaggcccgcccacaaggntttcgggccctccttcatagagacaccacccctgacctggggtacacggccatcgcgctcacagttgtcttggctggtctcaggagcactgtgggatgggcttgggggctcaggagggtccttcaggaaggaagaaggaggctggtggtgtgtagtgtgggcatgtgggagatgctggccccaagaatgatgttcaggtttgagcagaaccattggacctagaacttgtgtttcctttgggctcatttggaacagaaagctga

SEQ ID NO: 179 - DNA, 440 bp, Homo sapiens
  Genbank Accession No. AA084408
tatattgtcaggcctgtaattagttttggactggtagttagaagaataagtggaattatgtgaagggctattagtgttagttctcgtgtgtgtgagggttggaggttaattatatggttggttagtttgccgcgttgggtggtaataattatgtatattgagtatatacctgtaataataatgttaattcctataagaataatggtaaagtttgatcaagaaaataatgatatggtaatgaataattctcctattagattgattgaagggggtagagctagattagctagacttgctatcagtcatcatgtggctataagtgggaagaccatttgaagtcctcgggccatgattatagtacggctgtggatccgttcgtagttggagtttgctaggcagaataggagtgatgatgtgaggccatgtgcgattattagtaa

SEQ ID NO: 180 - DNA, 359 bp, Homo sapiens
  Genbank Accession No. AA084668
caacagatgaagaaagttttaatttcttttcacattaaacattgtttaccacaatcagctaacagaaattactgtaacattggtcacgatgacttcataaaactaaagataaatgttatgaggaaacttcatttaacgtgaatggtaatgttagatactgtatttttccatggtaaaatacaacttatcttgaagagaaagcaaatagttcagatcagggagacatgctgaggttttaataaagaaaagcttggccttgtccagaacacttaacaaagttcaggacaatttaggtaaaagagatgagtgagacaccagcgttaggcagggacataggctcatcattcaggctttatggt

SEQ ID NO: 181 - DNA, 413 bp, Homo sapiens
  Genbank Accession No. AA084901
  unsure (1)..(413): n = a or c or g or t
gagcagttgagcgcggggntggcgggcggcctccgtgcccatgattcaggggcacagctgcccagcagacacacactttcatacgcactcacaccccacccccagacacacccccaggtctctggaactggcccagggtcctgctgctctcacagccgcaggacagggctcaagggctaccctcacccccacccggcttcctagcgccctggacgcccacggccctcttggacttcttggtccctgaggggggacggatggggagaggggcggtggtcgagggcggcggcggtggcaggagtggaggtagaggtagctccgtgggctccggcaagcttggggctgggccgaaacccctcaaaaggggagaacttgagggggctgacgggggcccggggctactgttgaggcgc

SEQ ID NO: 182 - DNA, 435 bp, Homo sapiens
  Genbank Accession No. AA084921
caacataaactccaacttcactgaggtggctgaccacgtccacgaccaaagccgcctctaaactggaactcagtggctgagccagccccagcctcagctttcttgtcagctccagggggcacagcgctccttctgtaggtgtctctgtcagcctcccctcttgtgaatcttgcaggtcgctcaccctctggacctttgggccgaggcatgccggtctcgggacggctgcgacgcaggggtggcgggcacgatctccgggggtaggtgcaggtagtctcggagatactggatgccctcgttcgtaaggtaccagtagaaatgtctccaagcaaactgttccttcacgtagcctcgagacttgagagactgcatggccttcattacatgaaggttgggcacatttttgtctgccagctccgggtgcttaggcatgtg

SEQ ID NO: 183 - DNA, 572 bp, Homo sapiens
  Genbank Accession No. AA085987
  unsure (1)..(572): n = a or c or g or t
tagaatttatataaatttattaatttatttttagttgtaggaaacatcagaaaaaaagtaaacttgcccagcacttcatagctgtattttgggtttttatcaaattcagctccatttgacataagcaatgattatcttctcaaatacaccacccaccaatttcatagcatcattctttttccccaaagcaagaaatcatatgctgttctcagtgcactccaagccattcattcatttcacctacactctaaaggtacaaagcttcccttctttaaacacacaaggtggcacctatgaagcaggacagagatgaggactgaccattattggttaaggatcaattgcaaccatctgcagaagccaaaagataagattaaaactgccatttgcagtaggggcagcggtgggaccacctttgaatcccgcactcccaaacaggccatgtttcagagtaagaaaagtaatctagaatgccagcctgtctggcacgtcctctggaaaatggcacatggtcatcctgattcaaagacaccggnggggggcacggatacatatnccaatatcctttactg

SEQ ID NO: 184 - DNA, 415 bp, Homo sapiens
  Genbank Accession No. AA086071
ttcttgctttctttaaatctttatttaaaagtccatgctaataatgtgtttacatttttacagttacattatgatagaaactgttggattttttaaatatctaaaacaatggcccactgaagaaaggaacaattaactctttaattaattccttaggataaatacccagaaatttaacagctagggcagacttctaatacaataccgaaagtccttccaaaaaccaagtggttgccaacttatgtcccttagcattataacattcttgagccaatagtgtaaaaatacgctgacaattttataggcaaacattactcaaggtatcttactttccacttattactaaaggtaattaacccctaaatagatgctcctcaacagtgggactacatcctggtaaacctatcataagttg

SEQ ID NO: 185 - DNA, 408 bp, Homo sapiens
  Genbank Accession No. AA086201
tttttttttttttgctataaaattatctgggtttaattattatcaatatcagaactatagaacattaacgtactaaacctgtatttacaattacatgtacaaaaaaaaatgttctttgtgaggagcaattttcagcaaatctgacaaacagcaagagtcattcctattttgggtttgaaaagagaaatggaaatttccaagacgcccccctcctccctctcactccagtgaccctctgaacatcaatttgcaaaggcctgaggtagaaagggaggtattaacaatatcaggcactcattcttcccctcttatgaaagggatgaatttttaggaaccgttttccatcatttattatactgatgttgccatccatctgcatcattaggttcagtaggttaccatgacaat

SEQ ID NO: 186 - DNA, 460 bp, Homo sapiens
  Genbank Accession No. AA086232
  unsure (1)..(460): n = a or c or g or t
ttccaataagaaataagtttgtttattcctgtagcgtaaaaatctgtgcttcgggattcagcgaactcttggaaagcattttctgcatcctactggttcgttttccctgcaaaactgctgggatgcttgaagaagtggtagtcagttggcaagaggtcaggtgaatatggtggatgaggcaaaatttcatagcccaattccgttcaacatttttttttttttgaaatgaagtctcactctgtcgcccaggctggagtgcagtggcacaatcttggctcatccgcaacctccaccttccgggttcaagcagttctcttgcctcagcctctccgaagtagctgggatttacagggcgccantaacccatacccagctaattttttgtattttttagtagagacaggtttcancatggttggccaggctgttctcgaactcctgacctcaagtgattccgtcc

SEQ ID NO: 187 - DNA, 438 bp, Homo sapiens
  Genbank Accession No. AA086412
atgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatcttctagctccttggccttataataatggggagccacctccagaagccaactgctctcaatctccagtacctgtctcatgaactctttggtggtcaagacaagttcgtggtagagcagccagcgtggtgtttgctcaaagagggaggagttgggatgaatgaagactgtctgctgctgtttcactgtgcggtaccactccgagtcaaccgtgccgtgtggtaaaagtaaccagcagtgatggccttgcgtacacggatatagtccccctggcagga

SEQ ID NO: 188 - DNA, 354 bp, Homo sapiens
  Genbank Accession No. AA088698
  unsure (1)..(354): n = a or c or g or t
tttttttttttttttttttttactgttccaatgccagtaatcaatttattttcttcattaaaataatatacacagaatgtattgttagttcgattccttcaaattttatacatatttactttctgttaaagagaaaaggataaaatggtataaaaaaagataaagctattaattaagcacgagagagaagataaatggatattttccctgtgtgaggctaagacagaagcaaatctcgttaagaaaaatgccacccacacaacaggaaatttatccaaaacaaaacaaaagcngttatagaaccccttctctaccatcagaagtaatttcacagcaataaacttattggttaca

SEQ ID NO: 189 - DNA, 334 bp, Homo sapiens
  Genbank Accession No. AA089997
ggtaaatagaagtccttatgtatgtgttacaagaatttccccacaacatcctttatgactgaagttcaatgacagtttgtgttttgtggtaaaggattttctccatggcctgaattaagaccattagacagcaccaggccgtggagcagtgaccatctgctgactgttcttgtggatcttgtgtcagggacatggggtgacatgcctcgtatgtgtagagggtgaatggatgtgtttcgcgctgcatgggatctggtgccctcttctcctggatcacatcccacccagggccgcttttactagtgtctgcctagatggtcagaggtcatcaact

SEQ ID NO: 190 - DNA, 350 bp, Homo sapiens
  Genbank Accession No. AA090257
tagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaattctatctgttgcttgaactattttgtaataattaaactttgatgttgagaatcacaactttattgtacacttcattgcaacttgaaattcatggtcttaaagtgagatttgaatttctattgagcgcctttaaaaagtataccaaccataaggttaaatctatgtatattgag

SEQ ID NO: 191 - DNA, 277 bp, Homo sapiens
  Genbank Accession No. AA090434
ccataatgtaagaagctttggtggcaggttacagagttctgggatttcttctcacaggcccaatcctgaatgtgcccctggaccttctggacccttgagtccaaggcagatcctctctcccagggatccgacacaggaggaaccccttctctggttgagctgggccaggcctaagagtagcaggaactctaagaccacagagtttttataaatgtataaatgtatcaagccaaatgtgcagatgctaactgggacattctgggggactggacaccag

SEQ ID NO: 192 - DNA, 282 bp, Homo sapiens
  Genbank Accession No. AA090439
attgtattaagtttattcagttaattcacttgaggaactaaccagtttttactttctgtctagaatgatgtacatgtagtaattgccaaagccctcataaagccctccggcttgaggagagagtgtatagtcatgggttctgcctctgtgcccttgctggccgcttctcctctgccttctttctgggactcagggtgttggggctgagcctgtaggggacagcatgccgtcttgctgttggcactcccaagtgtgccctcttccctctttacaaacaagggt

SEQ ID NO: 193 - DNA, 370 bp, Homo sapiens
  Genbank Accession No. AA091752
gaaggctaaggcagtatctcgctcacagagagctggcctacaaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagagggacaccagaaaactgcttagagggatgctttaaccaccctcttctcccgtcaattgtactgtaactggggcaaagaaataatggggatatgtggattttacacagttaatggaagcatagcaatactgtgggatgttaaagaacattgtatgttc

SEQ ID NO: 194 - DNA, 316 bp, Homo sapiens
  Genbank Accession No. AA092129
tctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaactcagctgtgctccagactagagcctccttacctatctatatgtttaattaatttttctctatatcatgtactctgctttttttggtacagt

SEQ ID NO: 195 - DNA, 310 bp, Homo sapiens
  Genbank Accession No. AA092290
gccagaattaaaagtattttgggtggtgctgagggtcagaggaagaagtaaaaattgtgagaaaggagaaacatgggctttgggagaacccagaattggggacagaagacctggcactaagctatagcacttagcacctctgatcttgtttttcctcgtccgtaaaaggagattaacagtgcttttctgcccacctcttggggagaagggaataatttagttggtaaaaaaaaacttttgaataataagcactctgtctttatataagtagccaagcattattattatcacccatatcactggtagatac

SEQ ID NO: 196 - DNA, 313 bp, Homo sapiens
  Genbank Accession No. AA092376
ctggtgccggcgtttgggctacggttgttgttggcgactgtgcttcaagcgttgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaggcacaatttgaaaccaaaagctgtatgcaggagctattcttgagtttgtggataaattgggaaggttcctcagtccagctttgttagggtgataaccaactgttcagaggctcaa

SEQ ID NO: 197 - DNA, 368 bp, Homo sapiens
  Genbank Accession No. AA092596
atgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctgggtcaagaccagacagctttccaggcctggtatcaggagctctcagcctctgaggccctactagagtctagagttctgatctgttctcagtag

SEQ ID NO: 198 - DNA, 307 bp, Homo sapiens
  Genbank Accession No. AA092716
gcgagtctggaactctttcttcggggccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattcccccagctcctggagagatgtctaatatctcttagggaccagaccctaaattctctctccccatttgatgttagtgg

SEQ ID NO: 199 - DNA, 314 bp, Homo sapiens
  Genbank Accession No. AA093497
aatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggcaacaataaagaaattactggccagtgctaacttggaagaagtcacaatgaacagatttgcaaaagggtctatgaaagttatcctacttatgatttactgaagaaagatttcataaaacactgtaaagagctatttctgagatagagcagagagatgctcgtccatagattgagg

SEQ ID NO: 200 - DNA, 309 bp, Homo sapiens
  Genbank Accession No. AA093923
gtcataatggaccagtcatgtgatttcagtatatacaactccaccagacccctccaacccatataacaccccacccctgttcgcttcctgtatggtgatatcatatgtaacatttactcctgtttctgctgattgtttttttaatgtttgggtttgtttttgacatcagctgtaatcattcctgtgctgtgtttttgattaccctggtaggtattagactgcactttttaaaaaaggttctgcatcgtggagcatttgaccacagtggacgcgtggctatgcaggtgattcctcagtcttccttggtct

SEQ ID NO: 201 - DNA, 271 bp, Homo sapiens
  Genbank Accession No. AA094507
gaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagacttaggaaaagaggctcttcaacagcccagttattctggcccatgacct

SEQ ID NO: 202 - DNA, 207 bp, Homo sapiens
  Genbank Accession No. AA094517
aaaaccctcaaccctcaccttggaaatacaaagaagggagatatgaaagagaaggtagaatttaacagctatctaatgaatgctgctgaatttaattagatggagctggaaagccttttccagcagggcaagcaccttaatttttatggcatttattaggacatcttgagctactgcataaattttaactgatacacagtagttaat

SEQ ID NO: 203 - DNA, 278 bp, Homo sapiens
  Genbank Accession No. AA094752
gctgggaagagcttcagcagtcccatgtgcacgtccatgacttgcagagctttggccttgacaacatcaacatgacccactgtgtacatgaaggtggacggagaggtactgaggactcatcgattcgctcatctaccactcagcacgagccatccagaaggaaattgatctagggaggacaccgtagtcaccctcggtcttcctctgtctctctttctcctggcctgtggtgtccccagccttgccaccttcacctctggtcagcccagcccaggtga

SEQ ID NO: 204 - DNA, 344 bp, Homo sapiens
  Genbank Accession No. AA094999
gaggatcagaccttctttcccgtgagaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgactaacatgcatctgagtttaagttgcaaaggt

SEQ ID NO: 205 - DNA, 465 bp, Homo sapiens
  Genbank Accession No. AA098864
  unsure (1)..(465): n = a or c or g or t
gatgatcaataacttattctggatctcaggtttgtaagacttgaatgcaagagaatgaagaccttcacgctttctctgtaagttttcattcaaaacatctttcaatttcttttttttctttttcttcttttttgccctcattttagttagtttgagtttcttgtggctctgtagtgactggctctaatagaatatcccttacaactttgtggcagttaatttctggatgatcactgtgacttccatttacatgtatttggcaagattttagagtattttcttttaatggactgggttcaatcttnattctggaagcttcaccgtatttttcctgattttctataaaccttattttcacctggactgagaggctctccaaaggccagtaacttcccctggactccctggtttcccnaaaattttcctttacaacaatcagtttttttaatttcacaagggctggga

SEQ ID NO: 206 - DNA, 323 bp, Homo sapiens
  Genbank Accession No. AA099225
atttcattcattttataatactttgttttaattattatttagaacataaatcaatgtaaaaatgtgggtatatacatacaaaaatacataaaactaaaaagcaaaaaaatggcatttaacatttagccataataatatataacatactacaggtcacatgtacattttcattcatgataacttagtatgcctaataattatgttaaaacaatattcttaaaatgcttatgtatacaatggaatcttaaaatgtgtgtgattcgaaccatttacactgtcttaagcactcaaaagaaagaaactgtcttctgaatagttcctaa

SEQ ID NO: 207 - DNA, 358 bp, Homo sapiens
  Genbank Accession No. AA099391
tatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcaaaaaaa

SEQ ID NO: 208 - DNA, 275 bp, Homo sapiens
  Genbank Accession No. AA099404
  unsure (1)..(275): n = a or c or g or t
attagcataattactttattctaacanntagtttaacacaaattcctaatagtctgatccagggatctttggggtctacgcttcccatcgcctcagtgtccggtgcatgaggaaggtgtcctctgaagggcggggccggagttgaagtcggagagggggcagaccgtccagggtcaggtgtggagattcataaaatagcgtttctgggtcacacaagatggtcatgtctggcccaggcccaggtggctcctgttgggaggttgggcccaaagcaa

SEQ ID NO: 209 - DNA, 475 bp, Homo sapiens
  Genbank Accession No. AA099571
aaatactcaatttattctaatttgaattaggttggtgtaggatgacaaactccaagcaaaagagcatttcttctgggctcccagaaatagcttcaacaacacatttgtattttcccttagaaaattttattcccttgaaggagaatgatattgttgtattcacagtctctcccttcagagctctgcaaaaagagtaatcgtcatcagatcctcggcaaataacttctttgcgctttggaagattcatggtgttgacagttatatagagattgaaatataattgctttaaatctctccttggaatgtagaaaatgtgcaataatcctttggatcctttcaattctatacaggggttaacattaattgaaattgggtattgcattttatcacagtaggtgtatgaaatacttgcatcggatgagttgcagacccaatactgcttctgagcttcagtaaatatggaagaaaacagggg

SEQ ID NO: 210 - DNA, 476 bp, Homo sapiens
  Genbank Accession No. AA099589
ggaatgtaaatcttttattaaaacagttgtctttccacagtagtaaagtttaattctattaatggtttcataacacggttgatctaagtaatcatcagttctgtaaagtgcaagagcatgaccagtaaaatctataacgtcttgacccaaatcaaatttcttatacacatctcgcattgtggtcttcttaggatcaatgccttcaaaagttcttggatctttttcatcgaagttggcaacatacactaggaatttcctgaagcgacgtttttcaaacaatcccattaggctagatgccagggcttctgcttcagtggaaggaaccttgtagatttttccacccttatagacaaagctcccttcagtcactttaaaatccagatagcgagttacctctgtataaagcagcatcttaaccagctgaccattagccataaggaacttgggaatcaagtcaacattccagtctcttccag

SEQ ID NO: 211 - DNA, 425 bp, Homo sapiens
  Genbank Accession No. AA100026
ttttttttttttaaaagcaagaataatctttattccttggaaacacatttgtaaaaatgctatcaataagatgaaaagattcagaacacatttatttgtatgcagcacatacactgagcatcagaacgtctgctaaaatggaatacacctgtaaacaaatgccttagggagagtttataggtagtcagctccactgtgcaaggtatgcagctgataccttcttgctgaatagatttttgcagtagccaaaaaagatcagattttagtaataaaatatctcaaaggatgtcaaacattttttagagggcctaacatgggcaaaattacaattacatatacaaaaatggcacaagaatcaactgatttcacagaaatactaataaaacatttcagggtctattattaagagaaaaaaatgtttgact

SEQ ID NO: 212 - DNA, 456 bp, Homo sapiens
  Genbank Accession No. AA100719
tagttatagagctaattggcttttatttgtgatttatgaattaaagcagcaccactctacaagtacagtgatagctccccctgggcaatacaatacaagaacagtgggttttgtcaaattggaacaaggaaacagaaccacagaaataaatacattggttaacatcagattagttcaggttacttttttgtaaaagttaaagtagaggggacttctgtattatgctaactcaagtagactggaatctcctgtgttctttttttttttaaattggttttaattttttttaattggatctatcttcttccttaacatttcagttggagtatgtagcatttagcaccactggctcaatgcgctcacctaggtgagagtgtgaccaaatcttaaagcattagtgctattatcagttaccaccatttgggggcttttatcccttcatgggttatgatggtc

SEQ ID NO: 213 - DNA, 435 bp, Homo sapiens
  Genbank Accession No. AA101055
  unsure (1)..(426): n = a or c or g or t
tttttttttggcatcatctcatctttatttttccatgatgtatcaacactgatatcttcngaaattgtttcaggctccaaaagaagaggaccacatgtcactgatgctgtatgcttgataaaaagatgctcaaacgtttctggcttctgaaaattaagtccttgtgcccaggaacaattcttggggttcggaacatcttcccaaaatagctttntcattctttggtgtgatattaataatgttccaagcaataagatngaagaggnaataattacnggcacaattacntntaaacctgcatcactctggngtttttcaatatcancttacagtgaaactattaattancnttggttttcccactccttccntaaatantgggtaaagactgaacngggacntctnaatggggataaaatgatcangggnataaaa

SEQ ID NO: 214 - DNA, 512 bp, Homo sapiens
  Genbank Accession No. AA101235
  unsure (1)..(512): n = a or c or g or t
ccataatttattttaagccctaaaatgaaattgtgaaccattaaaaatatgttgtaaaactatttaatgtcataaagagaactaactctgtttttatggtccatctaccaatgtcttccgagcagttctctctcctcaaacctcctctacctctttactcaccctcactcagcctaaccttgcttccgattttattaaggaaatccaatcaatcagaagaggtttctacaatttactatcacatttacccaccagccatcacctctgccatatatgctcctctcctattccaatggctggaatgtctcagggaagaccaagcccttcacttgtacattagatcccagctctctgtcccatccattatggaagctgcacatcaccccagtcacacaagaggggcactctgaatgaggaatcntgtaaactactccaaatcancagtcttgaacagtcttgaacacgcatggggttaaagtactcctttatctggtacattggctaccttttta

SEQ ID NO: 215 - DNA, 493 bp, Homo sapiens
  Genbank Accession No. AA101272
  unsure (1)..(493): n = a or c or g or t
ttttttttttttccttctgtagtcgtctttatttagagcagaattcagactcagctggtatcccccagggcaaccccaggatggtanaggggctggtctgtccccacccacttctccaggatcctcccagcccccagntgcntnttccctccaactgtcagctgcttagctgctcatctggggattgcagctggagcatctgtcaaggttgtctccttgacaaacagcttcctctttggaaatggcttcactcaggtcctgcaggtcatcgagcaggacagagagggacccttttatggactccctggtgggcactgctgctgctacaggtgcagatgctgaacactctggaggcctggggntggacaccacagatttcttcttatccagtagggaaggaagaactgtcaacagtcgctgctgcttgtaacgggagaggagaccttcctgctgcaaggtggccagcatgaggttcttatccctctctaagctc

SEQ ID NO: 216 - DNA, 444 bp, Homo sapiens
  Genbank Accession No. AA101551
ttttctagtaagactagatttattcaataccctagtaaaagttttgattataagtatccaacagtataaaaagtacaaaacagatctgtagatttctaatatattaatacaaagtgcatgactacatacagtacatcctacaggcaaagagaggtggaaggggaaaaagaagactgtggttgaggtctagtaataaataaataaatacagaagtagagatgatccatattatagtatattctaccaccaatactgcagccaaaatgtacaaaaaaaatcatttcaaataactcaggaggatgataatggctggacttttgtaattcacctcaaagactgtgggagagccaactcaactcactgtatagtctgtgcatatggtggcttgtagcatgtaggttttttccaaaagaaggaaatataaaatgtttagattaagaacta

SEQ ID NO: 217 - DNA, 451 bp, Homo sapiens
  Genbank Accession No. AA101632
  unsure (1)..(451): n = a or c or g or t
tctcaacatggaaaaactgttcaggcacaaagattaaacaagcccgcgttgcatcccttggattgtactgaatcactgggtcccccagcctccctacctacccctgcaccccagatctgccttccccatattcatggcctcctcctccaaagcagcccaaagcagcaatgatatttactattttatatcaatctcttgctatatatatatatatctatatatctatatatttgtctatcctatatatacataggattttaatgctttgaatgagtgaaggagtgaatagggaaagagcacatgagtgaggtgtaaatgtcaccaaatgcattaagggacatatttgtaggagctggacatggggaaagggactattaaccaaccgtggccnttgccaggctgggagaagttttncactgtgctggataaggcagtagcaagcaggggttgt

SEQ ID NO: 218 - DNA, 419 bp, Homo sapiens
  Genbank Accession No. AA102098
agcaaaaaattttaatttatttgatttgcatgctacagagatttagctaaactttgttcatttggctagcaatattctttttgtacctgtaacacttaagattctgatatacaaaattgtaataatatactgataattcaaacttgagaactaaatattacattctttttaccctgtgcgaataaattctaccttttaaaaatagtatttataatattaaaattcatatttgtccatatggttttgtgatcaagttattaaaatgttttgtcactgtgaatcatttgggttagtacaaatatgacaagattattaaaagctgcctataaatacataacactattgctgacttttaaagtgtagaaaaaggattatattaaaataagttcatctctcatgttagaaatggaggaaatttt

SEQ ID NO: 219 - DNA, 260 bp, Homo sapiens
  Genbank Accession No. AA102489
agtctacaagttcagacccacatgtaacggatttttgcttcatggttgtcagaggctagtgtgcattatttctgaggattatatccaatgacacgacgcagaaaacacaaatggacggacagacggatggacataatcattaagacaagagactctaaaacgtgccttagtgtccacgtgattgatctaaggcggggacccttctaaggtggggacccgagtgatctaaagcagggtggcttccagcacaagggtgccga

SEQ ID NO: 220 - DNA, 421 bp, Homo sapiens
  Genbank Accession No. AA102571
  unsure (1)..(421): n = a or c or g or t
aatgtttcactctttatatataattgaatacttagttattgtgacaaaaagttagtatggctaaagaaaataatgcaagtacatcacctgaaataacncctgtatcccacgatacatgaatccaattccaatgctgttttctttctatttcagcaacactatacgtagtttaatagtcaagataccacttgaatactatccaagaataatcagatctgctcaagttaggtttatataatttaccaaggtgatagattctgactttgaagattactgaccactgatcactaagaactaatattagctgaccatatgatnccncaagaactaactttgactgataaatttgaatttcatcttttgtacactgaggaaagagattaacaattttctccacatcaagatggcttgtnttgaagga

SEQ ID NO: 221 - DNA, 469 bp, Homo sapiens
  Genbank Accession No. AA102837
  unsure (1)..(469): n = a or c or g or t
gcaccttgaaacaatttaataatgtattacattacagtagcatcacagcagcagtcaataatgccactttagacaaaaatcagtatttccattatgcattctgtgtataagaattcataaatcggtaaaagtcattctaagaaaacttggcaaatacagctttggactggaattggcatttctttgtctacttttccttcccctagattctttgttttaaactacagtattcatatttnaaaatgttttaaattattttaagacgttaatatagcagttacatttttgaatagttatttgaaagtgactgtaagataaagttttagagaatctattatggatagggttgatttacattttcacattttctaaaaatcagctttggttttagaactgattgtttttcattntgggaaaacctaccaggtttaatcaattactttaaaaataattatcatattttgcaggc

SEQ ID NO: 222 - DNA, 346 bp, Homo sapiens
  Genbank Accession No. AA112101
  unsure (1)..(346): n = a or c or g or t
ttttttttttttttttttttttaaaagactaatgtaacttcttttaattgtcattttatgctttctgcagctgcccgccaccctcccttcccttggatgaccacttttgtaggctataggggaccagggaacaaaggctgtttgnnnnnngggngggacanannanccccaatcanntgnnnnanannaagctanaattacaaatnnannacaanaantaatgctgannnctgggagagctgcanagnggggaggcccgctcctctttgtcagggtctatttggcagtgaccttgctctgaaggcgatggtactccttcagctgacctnggccaccccggatngaa

SEQ ID NO: 223 - DNA, 433 bp, Homo sapiens
  Genbank Accession No. AA112209
atcttatatttatattttatttccttctctatagagagagcaggtaaaaacatgtttagtgtttcctcgctttccaagttacattttatcttgagcagatttaaaacgagattagctgtaataggactccaggatgtgggcagatgtctacttgtcaaagacaatctctcttgcaatcagctccttcattatttcatttgtaccaccatagattggctgaactctggcatccacataagcttttgcaattgggtactcccacatgtatccccaacctccatggagctgtacacagtcgtaagctacactattttgtaactcagatgcccaatatttcgccatgcaagcagtggcggagtccaaacgtttcgcttcatgcagctggagacagttgtccacaaatgctcgggttacacatatatgtgtttttaag

SEQ ID NO: 224 - DNA, 373 bp, Homo sapiens
  Genbank Accession No. AA112679
  unsure (1)..(373): n = a or c or g or t
atacagattataaacaaatagaacaatgaatagtagtacttactcctttcttgtcatgaatccaggatttaggtcaactcaatatgaaaaactgaagcacactacagacaacaggacatagagaatgagtggtatttccttcaaattgaacatcttgtgaagtgacatatgtatcccaatgatgcaaataatgctcnaaactttttttttcatttttttacaatttttaattttttttaagacagtgtctcactctgtcgctcaggctggagtgcagtggcgcaatttagaactcactgcagcctcaacctcctggggctcaaaacaatcctcccacctcagcctttctgagtagctagcactacaggcacan

SEQ ID NO: 225 - DNA, 375 bp, Homo sapiens
  Genbank Accession No. AA112979
ttttttttttttttttgtttgcatcaaacaaaagagagttttattttaagctttgcatttccttaaaagtgaggactttgtcaaacatttttatccactctgagaaatgtacaatgattagaaaagtgcgtgtcataataattttcatatatatgtactccaaaacatcacaaacacacggctttgggataacttaaggagtataacctgaagattttcaaatttcataaattagcctttaatgaattgtacaaaatatttttataaaaaaagtttatgttttctgaacacatgagtatttaatcattacttccacctcgcaagactcacaggaaaataaaacagttcaaatagaaaaggagaaaaaagtccaaa

SEQ ID NO: 226 - DNA, 234 bp, Homo sapiens
  Genbank Accession No. AA113149
  unsure (1)..(234): n = a or c or g or t
gtgatttatttgcaatgggcacagtgatgcaaaaacaagatattaagactataaaatatgtgactacaaagaaccagcgaaataaatacatagatattagatagtccaataacttaaggnncccgtgcaacgatncgagggatccgcgcncacnggaagttcttcttgctgcagggcttggagagcgccggccacgtcctagcctcggtccgactcgtccagcgtatggcccgc

SEQ ID NO: 227 - DNA, 460 bp, Homo sapiens
  Genbank Accession No. AA113303
  unsure (1)..(460): n = a or c or g or t
taacaaaacaaaacatgtttttattgtttgattaacaaactggttgggggaagggcaagaataagacatgcggggaaataccagctttgattagtcagaaactcctgttatctgtacaaaaaaatgaatgttacaaaaatcacgtaaaaaaactaggctcaaggaagcagccgcccttgcaagagggctcaaggcacctgggaggctgagaagaggccaacctggccatgggcgtggctgcatggacagctcttccctcctgcccttccccagatgcccttccctcctgccccgagggaccactccctctccccaattacaggtgctacaaaactgccttgaataccaccgccaaggcactgccagagatgaaatgggccctggagcagagcctcaggtcttccctcccctgtagcccaggcctggagaaaggagggcttgttcccaggnccaggtgggc

SEQ ID NO: 228 - DNA, 579 bp, Homo sapiens
  Genbank Accession No. AA114949
  unsure (1)..(579): n = a or c or g or t
ntttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtccccttcatcattgctgggtcctcaatgcagggggccatttcatagatgaaatggccctcgccttccagcaatccccgccgtgctacaatggganttc

SEQ ID NO: 229 - DNA, 417 bp, Homo sapiens
  Genbank Accession No. AA115562
attttacaaatacattcatattcaaagacatgggtgcttatgggagaggatggtgtaaagaaagggaaaaaagccataaaaccagagaatctttgcatgggactgtattcctgagatcccaaaccaaagggatgaatgtgctgttatgccttaaatgtgtgcaccaggaaatgcaaactagaaagggtggctctgaagggtcctcaggtgaggaagacccccagggcttgagaatccaccaccttcatccttcaaaagagtacctcagttgtctgcttacgcttcagccagcatgtgtgagcttggtcatttcctgcaagccaggcaaccacaccagtgtataagcctcaagcaaatgtcactcccaagccccaaatgggactaaggcctctgctgggctaggcgtggtgtaaatcc

SEQ ID NO: 230 - DNA, 356 bp, Homo sapiens
  Genbank Accession No. AA115735
taaatatgacagtcttggatttatttgtaagtgtttaaaatgtccaatattcagaagttgtcaggtgttcttaccacctccccactccctcaaccagtccctgcttccagggtccaggagaagcagtgttcaggcagagtagtctcttgccagagcagaacaaggagtcctggtggccaagtggcaagtatgcaggctgggctggtccctggtgggacttctcctgggcttttcctcccatcatcttccttcacgtgtctctcagccctggcagagtttggagctgataccctgggtcatggccacagtccagttcactgggtggatgtgtccctggcttctgtccatgccaggct

SEQ ID NO: 231 - DNA, 610 bp, Homo sapiens
  Genbank Accession No. AA115933
  unsure (1)..(610): n = a or c or g or t
tttttttttttttttttttaatttcaggtcaagtttattatacagaaattatattaatgggtgggataaatactttacaggagagggtcacactctcagacactttggctcccaaagggcttggagcttttgtgaggctgagcatcttccaaccaggtgcatgcactggtttgccaacatcctcaccacgcccaatccagccccttcacacactgacatcgcctacctgggccctcctngnggnnttnntttttatctaaccagtgtacacaacatatttataaccaattaatacgtgtgagtcatgatttgtttaaaatgtcagcttttgtgaactgaaggggatgggcagaaggcaggatgctgtcctggtcaggaatgtgacccagattttaacactgctcctgcacgcggtaccatggttggtgacgctggtgaagtcgtcaaaacggagagccagccagctgcggtgttggggtcnaagctgaaagggtacagattccacagatgcagcatcttcttccagacgcggtactgcaggagcccagtacttgcagacatcgataagcagccggctnggctngctctggctccatgggcanaaaatccg

SEQ ID NO: 232 - DNA, 465 bp, Homo sapiens
  Genbank Accession No. AA115979
ttttttttttgaaattcattaaatacactttatttaaatagcatttatctcagttggctctatgccagttggtcttggtattggggtaagggggtattgcaggtaaaaagaggtgaagcagattctggctttcagtttcttagctcagaaattccagcaatccctgtagttctttgcatcccctcaccacctctggaatagagagcagggtcttataaatatgctgaacaatgtcatctagtttttctaactccttgtcagagccgccgaagttctcctctaggatatttctatggctctggaacttgatcatgagtttttccttctcatttttcatctccaggaacatcactctcagttttggtccacctcctgagaagagccacactttctcctggatccaattgggtgggccataggctgggcagtttggagtccagctgggcctgccagggcctcctggag

SEQ ID NO: 233 - DNA, 261 bp, Homo sapiens
  Genbank Accession No. AA116036
gagggaaagacaaaacgtatttattccaggccaggtcttaaaatgcacactgcacggttccctgttgttatcagcaccagtaaggaaagaacgtgccttaacggcagccccacccagagcctgctgcgtggctgctgtgaggctccccatgaatccacgcagtcttcttcctcactggtgcagttggtgaggttttctaccctcacagcaaagggatccttaactataaattcacggtatgcagagaagaggacagaatct

SEQ ID NO: 234 - DNA, 441 bp, Homo sapiens
  Genbank Accession No. AA116075
tgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgt

SEQ ID NO: 235 - DNA, 267 bp, Homo sapiens
  Genbank Accession No. AA121140
  unsure (1)..(267): n = a or c or g or t
atgtttagtttaagaattttattttaaaggaatttctgtggcataacataaggtttatggtacttttactaaaagtcacttataatgaccaaattataacaatttttgcaataagctctcattaaattttcctaaaagtagaaaaagtacacattatataccattttgcacttaattacttctttaaaatctcaaaataattcagtgtanaatgttagtttcaaagacaatttatgggaaattacaagcacttacaaaggttcctca

SEQ ID NO: 236 - DNA, 413 bp, Homo sapiens
  Genbank Accession No. AA121257
  unsure (1)..(413): n = a or c or g or t
ttttttttttttttttttttttttttttttttttttgcctctattgctttatttggtgttttatacaagtgactaaaataaatagagtaacaaaggcagctacatggcccaaatctcccagcttcctcaggctgctgtctaggatgcctaaccccggggtaccgctgaccacccccaaccctgcaaagggcagggcctgtgggtaactggaggaggaggtcacattctggggttagaaggggcccaatggatgggaattcttcatataaaagaggaaatgcctattaaaaaagtcccaaaaatgtaagaaactctattttaacccccaaaaaggcttataaaaaaacaaagctaaaaataatcaaaggtcccttgtctacccctgngggantggggaggaaccaggcactgct

SEQ ID NO: 237 - DNA, 445 bp, Homo sapiens
  Genbank Accession No. AA121315
ttttttttttgtttacttatttatttattttcaccaccaacattattagccatgcctttctgctaatcgattttagcaagtcgaggtaaaacacatgcaacattttctggcaaaagcttaatgtcaaacaatatgtgatccatactgtgtgtcgtccttgggggtttatttgactttgtcacaatgacagccaacagtgagactgataagcctgtaaaaataaaaaaataagactaatcaaatagacatggcattttaatctcaaagtgcaaaatcatctaactgaaaatgacggcattgaaaaattccagtggttaaaaatgaatcaaaacttcattacgcaggcagtggaagtgtgttgaaagatttaccaggggtgtcaagttttagacactcagaaaggcaccattctagccatcttgattggataacatggtatatactt

SEQ ID NO: 238 - DNA, 270 bp, Homo sapiens
  Genbank Accession No. AA122345
gataaaggaggctttttatttaaaggcaaaataccaaaatggctctctggtgtaggtgatttctactttcacactcagcttgtacatgatccgctaaccttaatttctttctccttaacgggctgacttggattgacttgttgagaatggtatccattattaatgagtcaggagagaaagggatttctgtggttacatgtaaacttgtgataggtctgcagaagttacatgtgaagaggatagtgaggaagtcagccatgatccatctat

SEQ ID NO: 239 - DNA, 318 bp, Homo sapiens
  Genbank Accession No. AA122386
tttgacaaaagcgtgcatttaatttgatgctttgcagagatacatgaccaaagttgtatgcatggcttgtcttttgggatggtcccagctgtttattttaaaagaaaaaaattaaaatagagccaacaaatgcaattaagaaaaaaaaagtattgagacacaaggggacctacatgttctggtctaagaagcatgcaagtattacaaagcattccagatacagtatgacagaggaacagtgaacaagcattggaacgatgctctttctttcagaaacgggaagtctaacagttatgttttcacaatggtagtgattaa

SEQ ID NO: 240 - DNA, 441 bp, Homo sapiens
  Genbank Accession No. AA125808
  unsure (1)..(441): n = a or c or g or t
tgacgtgttacctgctatttttattccccatttgccatcttctgattgggggttgatgttttacagatttttttttcaaaggctttatttcagtttctgaggttaggatgcccctgtgcccctcgctccacacctgggcaggtctaaacttccttccaggatggcctccacacacagcctcccacctggggtcacctggcttcctgggggacccgcaanganggggcagggagcagcagtccgggtgcggggatcgggggacctcggcgggggcatccacaggggctgcaagacctctggtcagcatggcgtgggtggggagagcgtttctccctggggtcctgagccagtgactcctgttaggacctttgtcccacctccgcctggtggaccggcaggacctggtctagccagtcctgcagcctccattcccccacctgc

SEQ ID NO: 241 - DNA, 430 bp, Homo sapiens
  Genbank Accession No. AA125831
gaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagactaatatcaaaattctaatgttgatactgtgtaggattgc

SEQ ID NO: 242 - DNA, 429 bp, Homo sapiens
  Genbank Accession No. AA125856
acttgcattaactttattacacaaataagacatttacaaagcacgacatgaaaggtatgtaacaaaacagacattggttttacaaaaaaagtgcttacaatttttttccgtgtgtgtgttttcccctttttttgtatttaaataaatagtcttgatggcctgtacgttcccaggctgctcttaacagggtagtggagacatgtttgaactgtaacatgctacggccacataatccacgcaaggaatagaccctgaggagaggctcaaggcagagtgtgttgggtgaccctgggtagggcttggttggccacttaccacatggttgccactggggccttgatgatcaggagcaaaaatcaaaggaaagatttgagctccaaggccaggaattgggccctggttgctcctgttaatgtcagcgcctagcac

SEQ ID NO: 243 - DNA, 425 bp, Homo sapiens
  Genbank Accession No. AA125861
gggatcaatttttatttgggcttctcacagtggttagagccactctgtcttcagaacaatcacagcacaggaaatgcgtcactgagactgcccagaaaagtctgaccagctgaatcttattgcttaaaatacacatattcacaatagctgacaaagggtaacgtgcctcacacaggaatgtgttcgcatttgcaaatcttctgactggctgtagcaccaaaccctccaccgaccccgtctcattcacgtggaaagccagcctcagtcacatctccctgggccccctaacgattccttcagctccctattaaatctctctctgagcagggcagcatcctgtagcgggggccaaactgtgacctgggaaccaagcccagctccgcaggtttgcatttccgtcttctcgtgcctttagggcttcgtgc

SEQ ID NO: 244 - DNA, 453 bp, Homo sapiens
  Genbank Accession No. AA126041
tttgcagggagtgcaacatttatttcataacagaaccccttttccacagagcagctgacagggggctgcatgaaacatactttggaaattaaagtgaactctccacttgggcataatgttatgtgggcacatggattggcttaaaagggaaacaagaatacttcaacatttgatcaacagtaggcagttgctggacattttagaaaaaggagaaatccattttttgaccatggctaaacatggggaaacagcatcacattttcctgaaccaccctaatcccagcccctcaagatccaccaggtatgcaaccccaaaccccagtcacatacattaaatctacacttttatttttttgttgtaaaatgtgctttttcctcaatgaactttaatcagtccaggacctacaaacacacacacacacacacacacacacacacacacacacacacaca

SEQ ID NO: 245 - DNA, 135 bp, Homo sapiens
  Genbank Accession No. AA126044
  unsure (1)..(135): n = a or c or g or t
tttttttttttttttttttttttttttttttttttttttttaatgtgatgagtggtctgggaaatccncgcctaacaaagtggcttttgattcaaggcctgaagaaggggagggcccactccaggtagatgacat

SEQ ID NO: 246 - DNA, 462 bp, Homo sapiens
  Genbank Accession No. AA126059
  unsure (1)..(462): n = a or c or g or t
ttttcaaatgtcaaaggtcctgtttattccggcaaaccggaaagaaaaagtgtaaataaaaaaagaaacagatccatgcactcaactcctgggggtnggggtgggggtgggagtgagggatgaggaatgggtgggaagcaaggagggaggggtggaaggacagagagagagagacagagagaggcagagacggaaagaactggagaaccagagccataaaaagaaaaagacatccataaaaaggcagaaagaaagaagtggtgtattaaaagcagagatcaataaaggagaagaggggaaattgaaaaaatagacagaaatacataggcagagaacaaaagcccagcaaaaaggcggggagaaagggcgtgacagagacagagagatcacccttgangggacacaggcagaatgaaaagggcccccagcccccggagcccccccaggcagcagcccgagcca

SEQ ID NO: 247 - DNA, 439 bp, Homo sapiens
  Genbank Accession No. AA126429
tagattagaataaaaatttatttttgtaaagaattatattttgtatttgcaaaagctgaaaatgctcataaaaattaccagcccagagcttggatttccaccggatccaccacgtgagacaaaagagtctgtcacttcttcttgccaggtttgagggccttttctagaccttggatgtgttttcgagggagctgatactcttcaagcaatagccagccgaggtggtggacctggtttccctggatctgcacctgaaggctgtccttggccccaggggagggattgacggtggtgctagcctggcatcgctgctgaaggatggcagccactgagtatgggtccagaccataggcctccaagttccggaccacggtcacctttttattagacgctctttgtgctagggtgatgtcaattggacagatttctccctttcttt

SEQ ID NO: 248 - DNA, 276 bp, Homo sapiens
  Genbank Accession No. AA126459
ctgtcaagctgttctttatttcagggagagggcaggggaggggctcagtctttcttggcagcagctttcctcatggcggccagtacgttgctcagctcctcccgcttcctcttggcgcggatgtgcgtccccacccttttcttgataaatttgagggcccgtttgtccttggagaccttcagtaactccatggcgcgccgctcgtacggggcaaagcacacacctcccgaatcatgtcccgcacgaacttggtgtgtttggtcagacgcccgcggc

SEQ ID NO: 249 - DNA, 263 bp, Homo sapiens
  Genbank Accession No. AA126561
  unsure (1)..(263): n = a or c or g or t
tttaaccaataaaacgtaacactttattattatttttatcttagaaggaattcaccaaaggcttcatattatgctatggcatctttaattataaaaataagcaaataaaataacttgcatctgtcattaccatgatatgtttcataacctttatatgcacatggagctttaaaatgtaattttacaataaataatgacntataccagatatgctcnctgttantccagtactccgcccaaaaccntaatatcattttaattat

SEQ ID NO: 250 - DNA, 359 bp, Homo sapiens
  Genbank Accession No. AA126719
ataaaacattcaatttattggtctttgtggagaattagatgcatcaccagtatattacaacagagccattaatcttgtagcttcatcaacattaactggtttgctttcatgacgctgctgaggaatcagttctttctgcagaggttcaagtgaaatgctttttgcgaaatgtgcaagttccttttgtacatttacaaaagctttatttactctgttaactttttcctcattcataatgtttatcttcttaagattagtggtaactggttttgctttgtttttagccttaaagtttttttggctggctatgtgaaatacattcctggacttcggccctcttaatttgttcttggccattg

SEQ ID NO: 251 - DNA, 565 bp, Homo sapiens
  Genbank Accession No. AA126722
cccaggacactgccacttcctttaatacagcggtgcctccacgccccgcatccgatgcagtgttacacgtgtgtgtcgctcaaacatccatcctactgcacatactcagtttcggccagcaggggggagcccgaggtagctcccgctcccttgagccaggcccctgccagacctgagctccctcccaagcctggcttccccaaccggtggccttcatgggccagaagccattccttcacggccagtcctccggagtagttgcccacggtccgctgctgcagaccactctgtggcacgggatgaggatggggacaggattgcctctcattgctcctcccactgctcgcgcggctttggggttgcctgccagggctgctaattgctggtaagaaatcacttctccgaatttcacaaccttcagcagcttcataacacctgtctggtgaacgactcttgctggaaaacgggatggtgaaaagccggcacgggaaactcttcgatagcctcgggtggtggaataggattcagcaggctgtgaatgatcaggggctccgaacttccaaga

SEQ ID NO: 252 - DNA, 421 bp, Homo sapiens
  Genbank Accession No. AA127444
  unsure (1)..(421): n = a or c or g or t
gtaggtcagagacagctggatcagctccagccacatttattacaaaatagtgaccgcagttctggtatagaaaagatccctgacagcccagtacacctgcaacggcccccaccccacagagttcctctctcaggtgcctcaggtgtggaagttctcagattcgaaggtttcctgccaggagggcgctgtaccgggcagttgtgaggggcaggtaggcacctacagcctggtccagaacgtacagtgggtcagacagggtgctggggtcgaagccctcatttgccatccgaactttctgctgtttgaaggtctctgtggtggccaaagactcctggagcctgaggaatcggggccgggcataaggtggcaagttctcagacangtnggtgtagagctgcataaggtccaaagcgttgggggg

SEQ ID NO: 253 - DNA, 447 bp, Homo sapiens
  Genbank Accession No. AA127514
taaagattaaaaatattttatttaaacttttcttcataaacacttttaacatttttttcaatttaaaaacagaatggatagcataaacatgtttgaatagattatatccacggcttgggaaaaattacctgacaaaaatgtaaaggctttcaaaacaggtataaaaggcaaaccttaaattattctaagatttttatatcggccctaggattatttgactactggcccaaaatgtacctaaaggtcaaaatatttttctatagacaaagtatgcccaagaggtatagggcatatacaagttaggtagaaaataacctctcccaatcacctcactggaccattccttcagaaagcaaacacctaatccttactatatactggactaataacattttaaatgcagttgttcccaaaatgtaaaaagaaaaccaaagaatttaagggaga

SEQ ID NO: 254 - DNA, 603 bp, Homo sapiens
  Genbank Accession No. AA127646
  unsure (1)..(603): n = a or c or g or t
tatgaaacaaagttttaatttttattttacatatttatacataaaactttcaaggaaccctctgaatccaacagaatgttaatagcacatctaaaaaggaacttcaggtagtcaacattcacaaaatgttgaaaactgagtaaaatatacatattacggagagctacaacttcactacgaggcaggcatgtattttttgacttgtatagcaccgtcatttacagttcttctttaaaactacagtgaagaatgaaaagtagtcaatgggaaaatactgttccaacttaaaatctctaaacaaataaaaataaagttaaaactactctcttttattaaccatgatttgtggtggtgtcagtactgtacattttttgtaacaatattttattaaaatgcctgatattaagtggcacagtaaaaaattaaaataaattaagaagcaaaggccaatcactggacattaagctcgacttatcaatgactaacactgatatttgtttctgcgccaccttagcaacagctttttaccaccacggaggcaaataaattctagctgttccnggttgaatggctcttcacttgcaggctttcccgccagtgctc

SEQ ID NO: 255 - DNA, 549 bp, Homo sapiens
  Genbank Accession No. AA127712
  unsure (1)..(549): n = a or c or g or t
gttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgctaggttagatcatatagctaatgaattaggcaggggagctattttttgaagatgatgaattaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaagggttgcctgggaagntagagtcccattttggttgatgaagctttgaactgcggttttggaaccttacctctcctcctttagcccaatatgctgtcttgggtcctattcaaataaagttatttcctcctgga

SEQ ID NO: 256 - DNA, 564 bp, Homo sapiens
  Genbank Accession No. AA127741
tttttttttttttttttttttttttttttttttttttgacttttgtcaaaatcttctttatttgctctgtaaaactcttaatgccccaattttactaacaaaccatttgtttacaagtgtcttaaaatccagataagtttaacaaagtggtttcataaaactataaaaactatgtatatagcatcacaaagaattaacatattaaagcattatattggttatcacataaaagcatcataagtttttcgtagcactctctctagaaaacagtacatgaagccaaaccaagatcttgtctgtccactcacataaaaggtcccaggtctgtcaatgagtttcatttaatttggagagccagtctgccacggagaccaccattctccacagagaaaactgccacatttgtgaggtgaatgaactttcagcatttatgttaaagtcatctctgaagtgacatccacaattttaattccaagtgaatggttttttccttggctaggcaccttttttaggtacatgttgcaaagtgtcttaagtgaaaagcggtattcatccccccaaagt

SEQ ID NO: 257 - DNA, 187 bp, Homo sapiens
  Genbank Accession No. AA127851
  unsure (1)..(187): n = a or c or g or t
ttttttttttttatgcaacctatggcttttactttttattaccaatatacaaagtacataaaaaatatccatttttactctaccttctctgtcttcctatttccagatgctttaagtaggaaagaaaaggcaaggcaacaaaaaattccatctattatactggaaggctgacgtttcaatggcncaa

SEQ ID NO: 258 - DNA, 246 bp, Homo sapiens
  Genbank Accession No. AA128177
gcggaaaaaagatgtccctttaataaaacgttatcaacatatatcgtacacaaactacaatgtatcataattacttttttttcctctcttaattcagaaccagactacaaggtaagaaaaaacacagaaacagctacaatgttcccaataatccgcacaaagtcttttttcaggcagatgatatctcacataatatgatatacatggatcagaaagggagggagtaaaacaaagaccagctacagg

SEQ ID NO: 259 - DNA, 399 bp, Homo sapiens
  Genbank Accession No. AA128407
  unsure (1)..(399): n = a or c or g or t
ttgcagtcagtgggttttatttgangagggggttttctgctgaactgagatggggttgattgaacggggacagagcgaagactggcagagggcacacacgggaccctggccactcccgggaccctgaccactcctaggctaggtccttcatgtcttcagtcaggcgagcctggggccccctgggnatgagcctgcatcctgagtgggcacccccgacccatgacaagcctcctgcaagggcagcttctagctcatggtccgtgagtcactcggggctggtcaccgggcactgggaaggtggccagagccgcgtctggggggccgagccaagcaacagcagcagcagcaggtgggcccaggcaaggcgggctgttgtcagagccttcctgcagctgctgc

SEQ ID NO: 260 - DNA, 411 bp, Homo sapiens
  Genbank Accession No. AA128553
  unsure (1)..(411): n = a or c or g or t
atttaatttatttatgtaatacagtgtagaaagctatcatggcataagcaatgattctgtacaatcatcctgcagaaaattaatttttggagaattcttggtaattggagaccagcagaacactccctccccccaccccgtaaaagtgcttatgatgaacagggataattttnttttaatttttttttatcaaagatccaaagatacatggacaaaaaaaatgttcaaattctcaatgcctaatgtgtgcacataaaacaggcacaaagaaatcaatgtgtatcctcttattcctatatcacaaagagagcagaagcagcaatctgtacagtaagatgcagtcatggaaaaagaattttctaagtcatttggaatacttaaaaaaatgttcaaaatggcatagtgatcagg

SEQ ID NO: 261 - DNA, 421 bp, Homo sapiens
  Genbank Accession No. AA128561
  unsure (1)..(421): n = a or c or g or t
attagaaaaaaaaacttctttaatgggaaattttacgattgaaatgatgtttcatcttatagaccacaaacaaatgtttttagacattgaaaagtggttaaagaccaactgcgcccagtcccccaagtgccattttctgagtgcagaatggagggtgacgtcttgagctgatgctgtgtccccagcatcaggttttctgttttccctcttctccctttattccttccttgtccattgccctcaaccttctttttctgtttgctctggcctggttcagtataacatatccatgaactctagtatgggcctacggacaatcatagctacaatcagactttctaagcaaatggggaatgtggatntacatataaccattagaaaccctatcatcacctcctagaggggaagtgaatttcttaat

SEQ ID NO: 262 - DNA, 232 bp, Homo sapiens
  Genbank Accession No. AA129390
ttttttttttttttttttttttttttttctcaatagataactttatttgaaatgaaatgcattttgaaaatatgaaaaataaatcacatctccccaaaatcatctaagagacatatttacacaagttctgaccatgctaaaaaattcatgaattgtgatggtgtataaagcatttggtacatgatgatacttgctttccagaagctggcatttgcatattataaaacgttaa

SEQ ID NO: 263 - DNA, 363 bp, Homo sapiens
  Genbank Accession No. AA129465
tttttttttttttttttattaacaagtgtaactctttattaagatggaattgttcttattaaagaaatagatgaaaatggttaagtacaattaaatggctccaaaagtcttacaatgaaaacaacagtcctgccagttgttctttccagaggcaaatacttttcattctcttagtttttccttccgttagttaccttcatgggtttttccaaattattgtttttttttagtttttcaagtgaatgcatatattaatacataaaattttaaaaaggcttttcagtttataatgcatcctaacagtcccctgccccatccctcctaattctccagagcaatgacttttaactcttttagcaatgt

SEQ ID NO: 264 - DNA, 422 bp, Homo sapiens
  Genbank Accession No. AA129757
  unsure (1)..(422): n = a or c or g or t
tgttttttttngtatttctcatgtatacttcatttattttattaatnancnaanccctgtaagggantnctttgcctagtcntccgactntgnttnatcttcatcttgactaatcnggaagtaacnaagtcgtaggtctccttgtcagatgcaancantcgaagccaatcacgaagattgttcttcttaaggtatttcttggtaaggtatttcaaataccttttagagaactgtttctcagaaacaactgtgattttattcttgaagcgttcaatgtgaacaacattcccgagatttccagttttgccattgactttaaccttctcccgtagaaattgctcaaaatttccagaatcaaaaattccatcttctactggatgagtaaggtccaaattaaacctccaggttgacctcttgggctt

SEQ ID NO: 265 - DNA, 255 bp, Homo sapiens
  Genbank Accession No. AA131084
caagacttacaaactgtcctttattcagagtgagactgcggaacattaataatttatcacgcggggagtccccagaagccctgtgcccacgaacccctgtggcggaggagagaggcggggactccgggagcttcctgagagggccgtgtcttgggagcaaggtgacatattcagttcaggcacgcggaacatgaactcaggaagtggggagacagagagacccatcccccaactcccaggacgggggccaggccc

SEQ ID NO: 266 - DNA, 435 bp, Homo sapiens
  Genbank Accession No. AA131162
  unsure (1)..(435): n = a or c or g or t
aaaggtgaaacatttttatttagtttcattacagaggttaaatagacttttatgacatccngagaaaatanangaattggngtgggcntaantgnganttgttctnactnttctnactgnttttntnatgcacagctctttcagttgnttncaaatatgaagtatatcacctcaggatgcagagatttttgaattctatttagcaatttccaaaagctgaagtctagaaccgaagacacatataaaaagatgatttttaaatggaaccagccaccttgaaaaatattttgaaaaacatgatttaaactttagaaaataaaacttttaatacttaagagataacctggatgccaacgttgcntggttgggccnggacctttcccaggacntaagacccnctggggaaatccatggggggcnccggtgganatgggc

SEQ ID NO: 267 - DNA, 562 bp, Homo sapiens
  Genbank Accession No. AA131220
  unsure (1)..(562): n = a or c or g or t
tagatttctcatagatttatttctgcgtcatattatatatagatatatgcatatataccttttagcnaaaggagancaatctatatacccttcccttccccaccaaactcacaaaaggagattaaacccttccaggattgccatcaagcttcccgagatggccagggcaangaaagaatcatctctcaacatgttaagaaacggctgccattcttaggctctggggttgaagcagcagcattcccaggacccaagggccagagagaggaaaagaaatgactgtagtgtgacaggattctaggatgaacatgtccagtgactcctgggcatggcagactagctcccagaattctcagggtgtgagtaaaggtgggggccctatggctcttcagaggctgctcaataggtcaggggtagggtataggaactggggatcaggcatgcagggatggggtggcagaaaaaacgcctgtggggttatgctccagacagagcgacccccatcanggctacccactactcaatgacatgtaatgnacagggacagatgctgagctcctta

SEQ ID NO: 268 - DNA, 237 bp, Homo sapiens
  Genbank Accession No. AA131584
ttttttttttctagtcccagcacttttatttgtagagttctcaaatcaaaagtaacaaataattatacatcaggattgttaggaataccaattattttacaactgccactacgtgtttcttcttctctgacacaagtggcacagatccaggcttgctgtgtttaatacgattcacttcctttcgtcgacgagcttctttcatgatgcgctgttcctgaatctggctatagatagatt

SEQ ID NO: 269 - DNA, 470 bp, Homo sapiens
  Genbank Accession No. AA131894
  unsure (1)..(470): n = a or c or g or t
taatttctatgcaatcagggtcctttctggttggtgctaagtactggaggagcagctgagcgngcaggggtgcccccgggnccggctgctggaagtgaatggggtcagtgtggagaagttcactcacaaccaactcaccaggaaggtgtgactgcctgtctcccactctcctcccccaatccgggcctgggcncacctcgggaaacgcctccttccccatgcgcctaacctccttatctggtctcctacctttatcaccatcctccccctctacagtttgtgccaggctccacttagtgcctgggaggaggggctgtggggggagcatacctcttctctccctgcccaggtgttatactgatgccctgctgggtcnccacagctttgggcagagtggacagcaggtgaccttggctggtggnagggcagaaggtggaagaacagtgtcgccagctgggattgcccctggn

SEQ ID NO: 270 - DNA, 464 bp, Homo sapiens
  Genbank Accession No. AA131919
  unsure (1)..(464): n = a or c or g or t
tttttttttttcctgagtaattttttattttgtgcagagacaggatccagaactcctgggctcaagtgatcctcccactttggtctcccaatgtgctagaattacagccctgagccacggccccatgccccgtttttaccagtgtatattttctactggaaaatgagacttttagggatgaatgtggacttgtctgttgaaacttgtaaatttgcttaaaaaaaaaaagatctccaagtcttcacaaaattttatattccccaaggctgccccatcacaatgcctgtgaagcttgactggcagacactgaggcctgaagctgggggctgcagggggtcactggctcacccggtccccccgtaatctgtaaaacatactgggtgagggaggctgctggaggacctgaatctctcccttctccaggcagtagtgaggcatatgctgntggccttgggccaattaaa

SEQ ID NO: 271 - DNA, 377 bp, Homo sapiens
  Genbank Accession No. AA132032
tatgaaaattctcagagataatgcatttataaacacagaaatggttacaacaaagatggccgtgatgagtgggtataatatatttatatatatatatttatatataaatccgtgtccggcatctgactgtggcacctagggagctaagtccagtccttgcgtttgccttgaactctcccttctccgcaacacccctgttttggagtttcacagataacacaaagcctcccacagctccttgggggtgggttggggagactgagagtatagggtctttgtaggcagagaaggagagaggcttcaaggaaatccgtaaaaccataacacacacttctaagccacctgtgaccaacttgggaatttctggccccttgggg

SEQ ID NO: 272 - DNA, 459 bp, Homo sapiens
  Genbank Accession No. AA132514
atacacaaggacaattttaatcctgcattttcctggagtaacatccactgctggctatctatggattgtaactgcatttgctaagaactgtgaacacaaagaaactttacatgaagtcacatgttgatacaggcacacaaacatctttcagcagcaacagactacatacataacgcataccagatagtctcgatggataaatctgcttcaccagtaattctatttagtaaaatccacagttaatggagaattccattttttaattttacatctttactacacatttttctaatactttatttttaaaaaacactcattcaagattgtaatttgcatggcgataaacaagggttccatgggttctaagtttcttaaaagtgtccacagcaacttaaaacaccacaagtcttctttccaatttgcagcacctgacttaaagtttaaattcatccaatacat

SEQ ID NO: 273 - DNA, 451 bp, Homo sapiens
  Genbank Accession No. AA132554
ttcatatttcaagtgtttttattctgagcagtaggtacaaaaaataatgacatagttgtgtctaattctgtatagttcagcaccctccacaggctgtcaatctctgatttgatctacttttaccagatttaacagatccttgaatttactttactgtatatacttccttcttgctcacattgggaatcaaactaatgctggaaacatgcatcttcagacttcattgaggaattccagattgagacacgctgggatgtggattgagtccatggttagagaagatggattaaatggaaacaaaacaggaaacatgtgcttggcatctaatagcagttgctgagggtcattccgctcttgtagttgtgcctggattgttcgtataaaggccactgttacccgttcttcaaattcattcaggggagtataaaggtttaaaattttgacaatctgc

SEQ ID NO: 274 - DNA, 462 bp, Homo sapiens
  Genbank Accession No. AA132983
ttttttttttttttggttttctagatccatgtttattttcagttcaaagacaaagtagaaaacttgagagtggaaaatgttaccttttagttcacactcctaatcccttagtccccataaaataaacattctaaagtgtaagcagtagaaataatggaaactccacagaaacagaaataaattagtttctttcagtcttggtggaggtccttttgccgaacaccatactccactgtgaacagaattcatcttgaacgaagaagaaatctttggcctatttcaccacgtctccagcattgcataacagacatttttcaaattcagtttcttctccaactgcagcaaaaaggcaaagagtagtctgtttcaggagtctgcatcgggtcctgtgagagccttggtccacttagaacaagcctttaacttggttctggtttcggtatccagatctatggtcataaa

SEQ ID NO: 275 - DNA, 456 bp, Homo sapiens
  Genbank Accession No. AA132986
ttttgggccacactgagtgaattttaatgcaggatggaagcacacagatgggtgatcaggtctctctttactgaaacacagaacatgtgccaaggtgagtccaaggacacctctgggaacaggtgaagcccctccccacacatacactccggtggatgtgagcgagggtcctgttgccacatctggggtcaggggcttggacatgctgcccttcatgggaaccttctgggtacctctcagcacagtaacgcagctgcagtctgtcggtgggggcccaggctaggggcagcaccctcttttggcatacgggacatgcctggctgcagctgatgtccgttagcctctcctgacacgcagtaaggagacctggaagtgaggcgcgtgggcgtggagttcccggtggagcttgctgcatcagcctttcttgccactctggggtcagtgaagtctttcccg

SEQ ID NO: 276 - DNA, 174 bp, Homo sapiens
  Genbank Accession No. AA133214
catattcaaaccatctttatttacgaaatactatcctgagaactattattccattaaacttcaatttgagaaaagtgcaatcacttaagtaacagcagttacttaaactgaaaatgagatcagtcaaaattacttttgaagaaagcaacaatattgtcaggtttcttgctgtgg

SEQ ID NO: 277 - DNA, 274 bp, Homo sapiens
  Genbank Accession No. AA133215
caagaacatcccttttaatcacaaaccactcatccacaaatgtggctatggggtaagcagtctaggctgggaccctttccagaggtaagtcaaggtcacgtccctgcccccttcctagggtggcggtggctccagccaggggggcttccaggttaataccagagcctcggctactctggactcctgtgagctcttcttggctggaagaaggggggcattgtgggcctgctctgtcccaaggctccagaagctgcccctacccaggcctgcctgc

SEQ ID NO: 278 - DNA, 417 bp, Homo sapiens
  Genbank Accession No. AA133296
  unsure (1)..(417): n = a or c or g or t
ntatacnattangtgganatcatttattacntggcatgtttacaccaactctaaagagaacnaagccaatttctgaaagcaaanaaaaaaatgagcgattcagtcntgctgaaactgtcaacagactttagacctggtggtcaaatgaagctgtggttaatttatgacatgtgagtaagcaattcaaacctacgagaagagtttataatctggtatgtggagtctcaggtgattttattcttttttctgacaaattcctgagagcaagagacttgtttagtgctaatgaaatggagaaaacgttgctgagccagttgctgagctccagatcgcaaaccttccctaccccccgttccacggctcttagagctgaggcactcatgtgaggagtcaggggacatgagcccacccctctgg

SEQ ID NO: 279 - DNA, 395 bp, Homo sapiens
  Genbank Accession No. AA133439
  unsure (1)..(395): n = a or c or g or t
gaaactgcaccacacacatttgaacctcatagccaatgaacagacccagcacttagcaacttctccctcctgcgccccagagaagggagaaaaagagggagcagaggagcaccagctacttcccaaacagcgccacggggaagtcctcgccatcactgttgctgtgctgcagctccccgctctgccccagctctctcccaacatcttccatgagttgctccaggtccaggtcactggaggcttcgtcctcaagggggacacttccagcctcctgggtcaggggttcccggtgtctgggctcttctttcgcagatgaggggcaggccccttnacacgctgataggcccaggttctttggcactgttctaacttcttttccctctgaaaagctggct

SEQ ID NO: 280 - DNA, 424 bp, Homo sapiens
  Genbank Accession No. AA133457
tctttctgtggtttcttcctttttaattactggaagggtttttccattttttctcctagtgttcctttgtttgccagggaatgtttcgggaaggctgtggagtgggacggtggggatgaagcggggagtcccacactctctgggtccaggcacaaagctatcctccgttgttctgatctgcagagccagcgccctcagcaggtacctagtggtggcagagcgtggcctacacgttcccaaggaggccgccagccgggctgtacccttaccttgggggtgtgtgcagatggaaggtgggaagagacagaccaacaggaagtgttctcttcaggggttgccagccccaccctgaatctcagagcatcctcctccccggcaaaaggccagggcactgtcccgaccatgggctctgtacaagcagagg

SEQ ID NO: 281 - DNA, 423 bp, Homo sapiens
  Genbank Accession No. AA133527
aatcgattctgatgtttggccacttgctccattatcattcttctcatctttaccttctattttcttagtatccttgctttcttttttttcagatttctcagacgatcttttctcttcttttttgacagaggcttgtgtcttgctacttctatcactcgtattttttttatctccagaacttcttgaactactcttttcatcattttctttcttcatttctttcttagagggatcaccttttactttttcaacagaaatcagctgtccatgcagctcagtgcgatgaagatgtgcaatacacctggacacctctgtgcttgaagacatagttacaatgccatagcattttgccccaggacttcgagcatttgtaactacttttgcactcagaacctttccatatttgccaaagaggttcttcaa

SEQ ID NO: 282 - DNA, 454 bp, Homo sapiens
  Genbank Accession No. AA133590
  unsure (1)..(445): n = a or c or g or t
tatatgggaacatactgtttattcaataagaaattaattttttatcgttggatttgaataaattttcttctcccaagcaatctgattggcagtacaccattgcagcatatactttattattatcatcattattattttccacaacatttaataccaagtttccttctctcacatagaatattacccaatagaagtctccaaaaggggccatagcacattcataacaaagatagaaaagaaaactttcaatgtctgctttccaatatgatgattcaactaaaacaaagctgaatttctcagctatgaaactgaaaaaatgaaaatcagcccatgtgtacatcacggccagccatgatcattaacacctccatgganatgaggggagaaaagagagaaacaactgcttccttcttacccaaacttctaatattagcttcaaattactttaaaaaaa

SEQ ID NO: 283 - DNA, 451 bp, Homo sapiens
  Genbank Accession No. AA133666
  unsure (1)..(451): n = a or c or g or t
tttgcaatcctcaaaccgtttattgacagcacaaggctcaacagcaggtgagcacgtgagggtgngaagcgcttgnaggcagtgtgggcaccaggcaggggatcccggagaaagccctctgccagggacatggtgagggcgtggcatcaccacgaagggagcataaataacactggcaggtgggtgggcagcaggagagggagagcggacannacacggggacacgcagggtcggcgggaaaatgctgggacagggtcacacggggattcggacacgcagacacagaagggatcatgggacgcccagaggatgccagagggggcagacacaccagagactcggggatgggcatggtgctctgcccgtggtggcccctcctccaatactcgccctgggctttgcaggcaggactgggcggctgagcactctcccagcagagccaagcagggg

SEQ ID NO: 284 - DNA, 436 bp, Homo sapiens
  Genbank Accession No. AA133936
tactttagtgttgatcagtttattagtatttttccaaacctgaagaatggtgaaagtttgtggtacagtgtggggaaaacagtaagtgtggctttgggcaagccacttcccttctatggctctcagttttcccatctgcacaatgagggggttggagtgtgtggtctctaaggcactgaatttcagtctgttctccatccatcagtggatatgtgagatgcaatgcaggggtgctggcctgtccctggtaatgagcgaggatatgagcaaagcagtgagtacagcctggaattccagctactcaggaggctgaggtacgagaatcactttgaacttgggaggctgaggtttcagtgagctgagatctggccactgcactccagcctgggcgacagagtgagactctgtctcaaaaaaaggattctacgactatgat

SEQ ID NO: 285 - DNA, 410 bp, Homo sapiens
  Genbank Accession No. AA134052
  unsure (1)..(410): n = a or c or g or t
ggtagcctgagaggnctctccattctttattcagtcccaataagttaaagggcaagggtagggggcagggctcttaggtgaggacgctgctaactgaaggcagcagttcagccagttgctccaagatgcccaccgcttggcacagcgggttaccctgcaggttgaggaggaccagcctgggnaggaggcaagaggctggagcactgcaggctgctggaggcggttgttgcacagtagcagctcctgcagccggggtaggttggtgacgccgtccagggactctatggcattatcactggcctgcagcacctcaagggcaacgcagggccagccagtgcaggtggcagggttcggaggcggattgtgttgacaaagtcaagatgggtgaccaagagcagctgttccagatg

SEQ ID NO: 286 - DNA, 462 bp, Homo sapiens
  Genbank Accession No. AA134063
ttggatttaataatctaggtttaatcaaagcaatttgcatttggattttggaatgaccactccttgctaaggaagctatgtacttcatgctgtggaaactggcaaatacagaatgtagcttgtttgttttcttagccttgaagatgaccaggtagagagacagagtgagaccaacagtttttctgatttccctgctcctcctattccttcctaaaaatcagactcattgtgaccagtagtcttgaggactcaagctgaatgatagagaaggcagctcagacagaaaagaaaaaaagtacagaatttgagaagatcggagatgaagaaaacgtacaaaattatatatatatttatatatataataacatgacatatctatgtacaacatggctgggacagttgaagaaactatacaatggtgttcagcattttccccttcccagatggactttaaggatgaca

SEQ ID NO: 287 - DNA, 389 bp, Homo sapiens
  Genbank Accession No. AA134158
ggaaggaaaaattaaccttttttactttctttctcactttttaaatcagccaaagtcaagcccgtttgccaacctgcatgtccatgcctgtaagcccttctcttggccaaggaagaaaggaagaaagaaaaaagaaacccaggggcctgtatcccctgattaaacacagcacagcactccaggcagacatgccggtggcggctcctttgcaccattgacctcaggccagacacctcagcgccaacaatgggacctcggccttccggctaggtttgccccaggctgggcaggaaaccagctcggccgaagacaggggccatttcgagcagtgggaccccaagacagcaaacccagcccagtcaggacttgacacttaggacaatatctat

SEQ ID NO: 288 - DNA, 404 bp, Homo sapiens
  Genbank Accession No. AA134549
ggcttccaataaaaaataattcaactttattagtatgaaatattttgagataattagtgacccaaatgcatgattctccaatatgaaaggtgttcagcataagcatacaatcatttagtaaaactgctctttatgagacccccagaaaagctggaggcacttcctctttttggtggagagagaagacactacttaactggccatttccttgctggagtttattccgattcccttttgtctgattcttcctcctcaaactcgactaaaggagtgtgtctgttggcctgagcaccttctctgtagaacactttctttactgtgccatcctttggagactttatggtatgctccatcttcatggcgatcataaccatgagggaatctcccgctttcactttgtctcc

SEQ ID NO: 289 - DNA, 466 bp, Homo sapiens
  Genbank Accession No. AA134968
  unsure (1)..(466): n = a or c or g or t
gagcacaaaggtccactttacttacatgaaggaacataaaggcatgagaaacagtcatctcaataaatgcaagacatgagcataaaagaggttctctgcctttccagcgttgttattacagagagaaacctacaattattttgttaaacaaaattcaaggctccaggactcatctctggagctgatatgtcttaaatactattatagtaggaaagggagaggagaaaattccccacccactcccccgatttggcccgtgtagcttccctttgagggtgtgtgacttgccatctgcaaaagtcatggccaaaacaggaactaacaggccaaactaccatcaatctagtcttctacagcaccctaacagagtgccagggtcctctgtcncctccgcacctgaggncaaagttccaggaagtttactgccggtgttaggaggtgagctcaagttcagtgtctgncttct

SEQ ID NO: 290 - DNA, 401 bp, Homo sapiens
  Genbank Accession No. AA134985
gagggactgaacagattcttgacaagcctaggcataaatgctccaggtttgggaaagaggtaaaataaataggtggttactggggaggctccaacacagccagaagggacactgtttgcttcagcctctgggcctgtccattgtttttgctgtgtgagctggggtgtggggtttgctgcaaactgggatccagaagaggaattctcggggctctaatgggtatcagatctgccatcttgcatcagcggggcctggttcttggaggtgtctaagctggtgcctaagggcttatccccagcatccttctgacagcctccagccgggacaggattcgtggggcctcctggtggacatagcatctgtagctccccaggtcttatgcgaagtagctggctccccgt

SEQ ID NO: 291 - DNA, 427 bp, Homo sapiens
  Genbank Accession No. AA135153
tttaacaagccaaagttgtatttttttaaacaggaaaattatgtcaatataaaacagataaaaagacaaaaatcaaaacacacaacacagaaaagcacaacactcaagaccagtgcaaacccttcccaacccacttcccaggttttaaaaccttgattacagatccccaaggattagactgtatcggagaggtcacagtattgaatcagaaaaagaagacatgttttaaaaggtctgtacacaggtagtggtgtgtggggtgggggatgtacacttcatcactccaacatcaaaaaacatgatgcaaaaaggatttcagcgatgaccacagatttctagaaccctaccacgtatgctagcccccctccccatccacttttaaaagttgcttttaaaaaggataaaaagtgcacagacactttcgtaa

SEQ ID NO: 292 - DNA, 435 bp, Homo sapiens
  Genbank Accession No. AA135407
tttttttttttttttttgagcaataaagctgtttatttcacctgggtgcaggtgggctgagtccgaaaagagagtcagcgaagggtgatggattatcattagttcttataggttttgggttaggcggtgaagttaagagcaatgttttgtgggcagggtggatctcacaaagtacattctcaagggtggggagaattacaaagaaccttcttaagggtggggaagattacaaagtaccttcttaagggtgggggagattacaaagtacattgatcagttagggtggggcaggaacaaatcacaatggtggaatgtcatcagttaaggctatttttacttcttttgtggatcttcagttactttaggccatctggatgtatacgtgcaaatcacaggggatgcgatgcttggcttgggctcagaggcctgacacat

SEQ ID NO: 293 - DNA, 413 bp, Homo sapiens
  Genbank Accession No. AA135558
  unsure (1)..(413): n = a or c or g or t
gancattttaggaaaccttttattgcaaatgccattctgcatattgatttttgacagaaagtatcagaaatgcttctttcctgggaaaaggaatataaatgacagcaagacacattttagttgctactaaagaacagcattattttcaatcattttaagtcgctcatttaaanangcaagggtntaaaaacgggtttaaaggtgggagcctgcaaaagggtaattaattaaaaaagtgtttcctccccgggaaacagcactgtttggtctgnatcaaatgccgaagctgggaatctgattctggggtgccgtctcttcgctactgggagttgctgaccagcaggctgcccattcacgaaaagaggttggcaaggccaggcccccaggtngcgctggggatttctgggctgggc

SEQ ID NO: 294 - DNA, 327 bp, Homo sapiens
  Genbank Accession No. AA135871
tttaaaatagctaaataaatctttaatatttctaattgcaaatgtacagaaattgcacagccacacagagtcttagaacaccaacagcttcctctgtacattattacatagttaaaagtcgcagctggagggaggagctccagcccaaactccaacgtttgcattttttccttttcacatacttacaaaagaggggagctgggacgcggtgtgggagctggggggctttgtggctgagtgtgtagaaaagagagaggctgtttccctggacagtctggctcccgcagtcgtgcgggccgcagggggaggtgtacctggggcagatgc

SEQ ID NO: 295 - DNA, 206 bp, Homo sapiens
  Genbank Accession No. AA135894
gctgccaccaccatgaaagagtggccaccacatctttattgcatactcaggtgaataacttattatacaatgaacactcctccattaggagaccatgcccacttacagaatgcagccgtaaatgcggtaaatctatttacagaggttggggtgcaagatgagagaagtatcagccccaggaatttgaagtgaaaatgatctacaaa

SEQ ID NO: 296 - DNA, 435 bp, Homo sapiens
  Genbank Accession No. AA135958
atcatgtttgtatcaagatgtagttaaactcatggcacattttaaacatctgtaagtcagaaggatcacttttggaagaggccaattactggcaaaagtgattcattatcaagacaaaaagtaaatgtactttggaagtgtaaaaatcttaaaaaatccttaaagaaccctttataaaagcaatgcaaagtatttactatacatctgaataatatgcacttcataattgtgcctcaccccacctcctaaaatcttatattgatctgtgttttgggtttgagagccaccttaatgtggaaatgcaagaatcagcaggatcaagtccaagaagaatgaagccagatggttctgtaagacccaatgtgaatagacatatacaacaggaattatttaaactgcttaaccattcccaccaaaatgagtagggtatattta

SEQ ID NO: 297 - DNA, 437 bp, Homo sapiens
  Genbank Accession No. AA136079
cagttaatttagaaagtttattttgccaaggttgaggacacactgtgacacagactcaggaagtcctgatgacatgtggccaagatggttggggcataccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcagagagataactttgaatagagtgggaggtgggtttgccctaagaagtttccctaagcttgagttttccttagtgattctggggccccaagatattttcctgtcacagttgacatccccaacacagtgtttagggctcagaaaaagataccctaaa

SEQ ID NO: 298 - DNA, 175 bp, Homo sapiens
  Genbank Accession No. AA136269
  unsure (1)..(175): n = a or c or g or t
gttcagcaaatttcattggattaacagcggctgggttatagtagctaggaacagctattcctgtctctgccaaagctttanttgcagggctgccatctgagctgccatggctatctgaggtgttacttgtgttcctgatgccaacagggcagcaacattgagaacagaacctcca

SEQ ID NO: 299 - DNA, 429 bp, Homo sapiens
  Genbank Accession No. AA136332
ggctttctgggtcttttatttgtacccatgtgtctgtcacaccatgaatgtacctggggaaatcaactgacctccctgaacatttcacgcagtcagggaacaggtgaggaaagaaataaataagtgattctaatgctgcctaggtcaccctcaacccccatttactggcacaattgggtggagagaagggaaggggtatgattgtcctgatggctcagggttgcaggaggttcagaggggaaggaggaaaggccaggctggaggctgggctgttagcacttccctcccacagttcagacggctcactctgggctcaggtttgccatggcttcctttggtccaaacataggccctgtccttagtcctgtgccctgtttgacttttggccaggaggccttttttgtgctgctgctgttgcagggctagctg

SEQ ID NO: 300 - DNA, 435 bp, Homo sapiens
  Genbank Accession No. AA136333
  unsure (1)..(435): n = a or c or g or t
catgcttttcaacaagattcaacatcttttatttacatgtttatgacatacattaatggtcatacacaatttttaaactaaatctagtaacaacagaggatggaacataaaagacacaattccaaattttagtcaggttgaaatgtttttccactaacctgaaagataagataaatgagcagccattataaagttatgggctgtatgtcaattcacgtcttaaaattgaaagtcagccacacagctgttaaaacaatgggaaatttgcaaatgcaaatatataatgcatgcacagctatcacatttattctttatccttaaagccatttttaaagtaaactgggagaggcaacttagtaatatatgtacatcaaggcacattcttttcttgtgctttaggaatgatttacatgtgatctgcntatatcntaattt

SEQ ID NO: 301 - DNA, 441 bp, Homo sapiens
  Genbank Accession No. AA136474
caaaaatgaaatatttattaccgctttttgtgacttaacaccttttttttttaacataacgtcacagtcctcatacaagtattttaatgtaaatttgacaaagcttaaaggtaacagcattttcttctagtgaggaacacgtgctgagaaaagaagaattcatggacatacaataccaattccacagcagatctgatactagcaaaaacattcttttttttttcaattgaggtaaacacatagaatatctaacatgaaacaattaatagaccgaactctgtacgaagtttgttacagtattctcttgctcctttttatcccccaagctttgagtttctgataaagtcctagttatggttcaatgaccattaataactttttttgtgttgaggaaagctgcccaacttaagattgttttgtccacaaccaaggctcagaact

SEQ ID NO: 302 - DNA, 388 bp, Homo sapiens
  Genbank Accession No. AA136547
ttcttaagtagctatatttattattactttttccagcaattttgcaagaggcagaagtgtgacattgaattgagtgagacgagcgtgtgggtgggttggcgaggagccattctcctgacgcaggctgctggcttgtcaaggaatggctggttccaccgctgggccgtgtttactcttttgcttcaaggaaaagggtttcttgagggaacaactttacctccaataatgatttatttgggtccagttgagttacgtctctcctaggaaaggtgctcagtaacttgtactcatcccatggaaatcctttggaagctacaaaatcaaagacaatctggagcttgttgctggccaggaaacgccgctccaagaactcgccactgggggtccg

SEQ ID NO: 303 - DNA, 397 bp, Homo sapiens
  Genbank Accession No. AA136611
aacaaagaatacattattattattataaggtactcatgagtaaagaacaatgaataatatacatctaattttttaatactcaatgcacaatcaacatttctgatcaacagtataaaccatataaaagagaattctgcttttcatttgtacaaatactgctttcatcattgcaaaactttcaaggttaaaacgtaccatatgttgaagctataaagctattgcttgaatgtttctaaaacgaagttatttgctgtctgttgttaatcggttacattgtcacctctaataccagtcatcaaatccataggatctcttaatttccaagagattgtattgtacagcaagattatttttgtggccaaatcaggtcataggattcctttttttttaaagataa

SEQ ID NO: 304 - DNA, 439 bp, Homo sapiens
  Genbank Accession No. AA136864
cacacagacacagaatttatttctggacgcattctgcaggctggaggtcccggcagcacagggctcacaccttgggttttgcaaacacctcccagccctccagccggcccatcttgaccagggaggccgctatgccaaagtacacgcaggcggcggcgcaattcccgtagttgtgcgtgcgtgctcccagagtcaggcctccgggcagcacccgaggaagtagttcagggggtcgtcgggcttctcgcggacatgggcgctgatgcaggtggtgaggccaaacacggccccgacagcagctgcagtgaacgtgtattgtccaaccttagccactccttcaaggaaggtgcccggagatttgagtgtgactctgtaggcagcggcggtcaggccagcgacgctgaaaataactggtggtgctgtaggctttgcggtggca

SEQ ID NO: 305 - DNA, 365 bp, Homo sapiens
  Genbank Accession No. AA136940
tagttttttttgaatatatttacaatataaatactaatttgtttccaaagtacatattcttttaacaatttgagaaaattatctagcatacgacagtaatttaatgtaaagactctatagtagtgattaaggaaaaatagaactgttttggggataaggaatcctggctatgaatgggcatgatgatctgaacttgcaaagggaaagtgaagcagcttagtccacattgcactgctaatacaatatgttaaaggactactatgtgagatagcaacctggatatggtgttaataaaaactaaacatgagaggatataaaaagtacacatgcttgcataggtgtgttacttttaaagaagctccacc

SEQ ID NO: 306 - DNA, 391 bp, Homo sapiens
  Genbank Accession No. AA142849
tttttttttttttcaagtaaaaacttaaaacgtttatttctggtagaaatgataaatactttgcattaaaaatctggaattcaagttttcctcgtacttcatgctccctccctgccccagaaccttacaaaaatatttctgtctagagagggaaagagctggtgcctgctctggaggcaacgtccaggtccgggaaaggcactcgtggtctgtgatctgtctcagtgatgggaggtctccactcgccccacaggcagcctcggggccagagatgagaatatgctgtaatccagtacaggggctgcgtcgtgggtccccaacagctccttctttggggatagtgagcccctgttggggagtaggaagggactgaggggccgtcccctcgtgc

SEQ ID NO: 307 - DNA, 463 bp, Homo sapiens
  Genbank Accession No. AA142857
ttttttctacacatactccttatatttcattattctaagttatacacaatgttcaacaggagtttgaagtttatttagtaataaacataagtcatggctgacaactgagaaaatcctattcacataaaccatcatagattaaaaatacatagtatttgtactttaatgcaatagggtcccaggattcaaacaaggaaatttgattccagagttggcattatgtagttatgtactctgctacaaagaactagtggaggtaaacttcggcagtaaaattctcaacagtcaaatattaatgcatttcatatacatggctttgcatccgtagaggaagatacagttcctcagcacacgtgccaatttctgagtctccactagagaatcctcaacagtttcttcttcagaatcaaattcctgattatccgtgattcaaattatccgaggttcaccattcacctcgtgc

SEQ ID NO: 308 - DNA, 511 bp, Homo sapiens
  Genbank Accession No. AA142858
ttttttttttttttttttcaaggggaaactggggcagttttattgacgatggcaatgtacaagactccacacctaggtatgtgcacgaggtaaggcctgagctcaggccttatgatcctcctcaggacccttgggggcaaacttctcctgcagtttcttccacatgcctttatctatttccttaagctcttccaaggtgtctgtggacaggatcagcttgtactcttccaacgacaggccactgaagctggtgtctctggggcgagggtacttgtgtttgtagtagtttgaatggagtcgcgctaagtctcgtacatctgatcacaggcctcaggtctgcaacctgggtattctctccctcccgaaaggcctgtgctacccgctgtcgcaggtaagcgcccaagtcccggccccgtttggtctcgtccactggccattcctcacagagcttaagaaaacgccggtaccgtgggccgccatttgggccccgcgtgttcccgcccctcgtgcc

SEQ ID NO: 309 - DNA, 624 bp, Homo sapiens
  Genbank Accession No. AA143019
  unsure (1)..(624): n = a or c or g or t
ggacacccaaagaatgatgcagtattaaaggggtggtagaagctgctgtttatgataaaagtcatcggtcagaaaatcagcttggattggtgccaagtgtttttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtattaagtttctaacactgaganaaaaaaaaaaagg

SEQ ID NO: 310 - DNA, 479 bp, Homo sapiens
  Genbank Accession No. AA143493
  unsure (1)..(479): n = a or c or g or t
tttttttttttttttttttttttttttcataagaagagagttttattcaacattatggcatggcagtgtaattgttccaacaaagggaacctactttggtgcccgaggaaatggctgtttgtgatgctggggaaaagtcaagatgctgacgcctaatggtggttctagctttccaggtttgtaacatgaagatggggaaggaaatggcaccactgctgtttgtaatctgaggaactcttggcagcattcactctccaaagcagtacaaaacttacaaagaagtcaaaagtcttaacactcccattctcccaggaactcttgnctgtgtcatctggtaaggaggggaggaatcctggtttccctcaggtcccttgtcatgttagctttttgatagcttcaatccactcggctcgttcagccttgctggttggcctgaatgtaatagtgtgtgtcancctagtaatcnctttgaagaggtt

SEQ ID NO: 311 - DNA, 275 bp, Homo sapiens
  Genbank Accession No. AA143763
tttttttttttttttttttttttttttttttttctgatccatgcatcctttattccattaccaaccactgtgccgcatccaagcaacagtacacaaactggcaatcaaccgcagtccagttgtacaacgatctgaggcttacagtacatttaaggcttttaaatgtggaaaaaaaaattaaaaccaaagaacccccaaatccaaacccctaaccaacacaagtagtatagcaatgttaagcatctcctatttctgatgcttatttggcgcaactt

SEQ ID NO: 312 - DNA, 429 bp, Homo sapiens
  Genbank Accession No. AA146619
tggagataaaaacagcgaagtcccacataccataccctacaagacacaaggtgcgcagacgagccttggtaatgtaccggcgctgcaggaagaggctgtccgccgagcctgggctgctccagctacgcggggaggcggccccattgcaaagtgcagtttctccgcggaggtggcggtgggtcagtggcagagggccatggtttccatgttaaggaagcggacgtgcatcttggtctcaatgtcgatcccctgccagatcttcaggaagtcctcgaaggtgatcccctcgtacacctgatcaggctccatcttgccccatgcacacgctggccgcctccatcatggccccgtcggcgatggagcgagcggactccttctcgatgtgagggtttcccgacagcagctcctcgaccactttacatttcgagg

SEQ ID NO: 313 - DNA, 274 bp, Homo sapiens
  Genbank Accession No. AA146849
  unsure (1)..(274): n = a or c or g or t
ggttttctacctttaattggggatanaaaaggcacctctcccagtacaagaggatcaaccangaggtganccccagtgctgtggtgcccggncagaaggaacagaggaaggatggaggncaaggcagcggtgaccccagtgctgtggtgcccggccagaaggaacagaggaaggatggagggcaaggcagcggaggggcagtggggcccagcatcccctgaagcctcacctgcagcctggggctgattgagatctcgcccactgcgcgcagang

SEQ ID NO: 314 - DNA, 554 bp, Homo sapiens
  Genbank Accession No. AA147084
  unsure (1)..(554): n = a or c or g or t
tttatgagcaaatccaaatttattttaatgtcatgtcattttcaatgtgtttaaaaacctcataagttagtgggagccctagtttcctgggacagcatgccagaggtactgaaatttgtcacctttctctacaaacccccagcaatccaatccaagtccatagcttcagaaagccaggagttgtgtcttcagtcagtctacgcctctggttcntgggttttccttncatggggaggggagatnncaanatttcaaacaggggaacaaaaccaggttgaggcttccangctcagggtctgtgtaagatggagcgaggaaagaccccactngactccagagaaaaaagggtaaggtttgagatggattatttcntttacagctttggtgaaaatgggaagaaaaaagatttacaaatgaggatnccatttcataggatggagaatctcttcataaatgaaggctccaggtcccaaaatggggagggggcctgactggacagcctgaatcngatgaggaatcggccacactggattanaacaatctgaaaaataatc

SEQ ID NO: 315 - DNA, 414 bp, Homo sapiens
  Genbank Accession No. AA147439
  unsure (1)..(414): n = a or c or g or t
ttttttggcttaaacaacaaaggtttatttcttgctcactacatatccattgtgggttggtggggtgggagtgggggattctgctcatcgcttaggaccccaggctggcagaggagggtttcaactggagagctgcttctatgtggcaacctggacccaggctctcaaagcttctgcccagaagtgaccctcggcggttctgctcatgctccactcgccggggcagccccgacctaacctcccagcaggcagcnatcacatgttacaggtgcccaggagaggagaaactgcacctttgtcaacaaagacgaccacggaggggaagactgctgatggagggtggtcaggagtaggggggcttgttcctgcctgcagtttctcccctatctcccaggactgagctcgacacaggca

SEQ ID NO: 316 - DNA, 415 bp, Homo sapiens
  Genbank Accession No. AA147626
gtttaaattacattatttattttttagatcatccctcttagtcctgcatgcattgttagcacaaaaagttgaacttgatcacaacttcctttgaagagagagtaggtacacaatgaccatctgaagagtttctccacggagggaccaagaattccagacgctggtaacactgtcagtaacctacacaactttcaatacaaaaaaatttaccaaatatcctgtttaatgtaaacaaggcaggaggcaaaacagagtattacagtaacactattttacagggcccagaaaatgtgattatctaccatgttttaacacataaagtgtcacaatgacatgcatatttgatttactacataacccaaaatataattaccatatagtgtggttttagcacttcactgtaacgtcttctggg

SEQ ID NO: 317 - DNA, 325 bp, Homo sapiens
  Genbank Accession No. AA147646
  unsure (1)..(325): n = a or c or g or t
gttcctaacacaaatgtgaatttattggttgatttgatatttaaaatagtacttttacaaaatcatctcagaaaatatactacatttattaaaattcctacaaaccattgcagaaaatattaaaccctctaaccaacctaacactcgctttcnnnggnccctggtgatgattttcacagcttccatagttgcaaagaacaaagaaatcatcttccaacaggggtggaattagataagaataatccaaaanatatttatttctttacagactcacagattgcttggatgtttaggggctcttaccctaggataccctaattattca

SEQ ID NO: 318 - DNA, 352 bp, Homo sapiens
  Genbank Accession No. AA148480
aaagtaatttctttattgagaaaataaagacatggttcctaaggaaaagggctaaaaatgaccatgtttcaagtacactagtgaatagcaagtgaaacaaaatgtcttaagcatctatatgtcttatcttagatacatacaactattgtaggaacattatttctcttatctctcaggaaacatatttagttataatatgaaaaaaaaactaaaattgagcttctaatagaaaatcaaaccctatcagaagaagagttacgtggagtaagcgattttataccgatgctggacttactctccctaccataaaatttggataaacaacaaacatttattaagcacctaccacatg

SEQ ID NO: 319 - DNA, 555 bp, Homo sapiens
  Genbank Accession No. AA148539
  unsure (1)..(555): n = a or c or g or t
ctcttgtctagcaatctgttaggcttctgaaccaagaccaaatgtttacgttcctctgctgcataccaacgttactccaaacaataaaaatctatcatttctgctctgtgctgaggaatggaaaatgaaacccccaccccctgacccctaggactatacagtggaaactgttcattgctgatgaatgcagcagtcaccaaaaaatacacccaatcttccagataacctcagtgcactttaggaaatcaaaaattacctggaagcaatttagtacatagattggctttttaaaaaaactttttttttttttttaaaaacagcagcattaaacttagtgacatgacaccgacatgattaataccatcttaacacactcagaattccgcctttcacattataatcaagcatagtgggtaaactggttataaaagtgactttgctacgagagacaggttaggggaacaaacaacctggacttatgggtagaacccntagctctggttcagattgccataaccatacacatttttaacnccacggtacactgtacagctg

SEQ ID NO: 320 - DNA, 452 bp, Homo sapiens
  Genbank Accession No. AA148885
  unsure (1)..(452): n = a or c or g or t
ttttttccttccatcatttatttaggaaaaagttttatgtattagggtaaagtggtagaagttaacctagaatctaataatctccaatcacccattcctgatctaatagtagccatgagaaaaaatctctagaaagaatcatacctctcaaaaaataaaaaataaaacaaaggctgggtgcagtggctcacacctgtaatctcagcacttccggaagttgaggtgggcagatcgcttgagcccaggcatatcgcttgcagcctgggcaacgtggcgaacgtcctctaccaaaaaatacaaaaagtagccgggcatagtgacatacacctgagcccaggaggttaagcctacattgagccgtgattgtaccagtgtactctagccagggtgacagagtaagaccctatctcaaanaaagaagtgccataaaaaagaaaaggctctagccttta

SEQ ID NO: 321 - DNA, 367 bp, Homo sapiens
  Genbank Accession No. AA148923
gtctgaaactttttccttttaatatggtttacattctatctccagagaaaacacacttaacagaagacagaaaacatttaacaaatccaaagcaattaaaaatagccacaaaaaaagagaataacctagactgacagctcacagagcaaggaggtggcagagacctgcccaggtgagcttggctgttgcccccagctcaatcttcctcctctcctctctctgtcccttcacctctgatcagtcccagcctgattcccgttccctgatgcctcaccttcttgctgccagatgcctctaggaactagggtccttcagactccagatgccctggcctgggcttaggacatcttgacttccccagtggaca

SEQ ID NO: 322 - DNA, 425 bp, Homo sapiens
  Genbank Accession No. AA148977
ttttttgaatcaaaagcagggtttatttttctatcaaatccccaatccatgttccagccaatggatgaagggtgaatcaagccccacatagactcttggtaaaaacaattctaactttctaaaaaaaaaaaaagccaacacacttttttctttcttttcaaaaagctcccaggcctttgggaacagctgaaacaaattcatatcctgactaggtctgttttctcttaggtatttggatggtccctctctgctgcgacttctgcacagatgaggcactgataatggcctgcaggtcactcacaatcctagctccacatcactccatggtttgataacctagaaccacgttatgatttccatttataatgccctaagaacagctgaaaagatctgtattaaattctggcaaatctttattgagtgcc

SEQ ID NO: 323 - DNA, 567 bp, Homo sapiens
  Genbank Accession No. AA149253
  unsure (1)..(567): n = a or c or g or t
aatatggacagggagtctcattgtgtttatcatatcaattaatattacagtacatccttggtaatacaaaattgtacaccttcatcaaataaattaggataaattaaaccaataaattatgcaaagtcttcagaacaatagacaacaacaaaaattcacaattgaaattgcctctagctaaaaaaaacaaacaaaaatcaaaaattgactttatcagttcagttattgtactatattcaaatcaaagggtctttattacaaaaaagagcttaataatgctatttacaacatattgctaaataatataaaggcagtgttttgtcacggtttatactatatacatatgagaaatggctgggacaatattgagggaagcccatgaccttttggattcttccaggtagcgctgagaccnatcccaatacattttttttccttagttccaaatttgganggcgtaatatngcagttttnagaaattttccnccccccntttttaggggggattggatattttanaaaaattccggatggaatacggtttccccnaaggagggtagcntggtt

SEQ ID NO: 324 - DNA, 329 bp, Homo sapiens
  Genbank Accession No. AA149530
  unsure (1)..(329): n = a or c or g or t
attcgttttttttgtttgttttttttttttccaaaataagcccagaccattaaacaagtgaaactccaacaaataagtcttctccaacagcgagaaaaactgtacagttactcaaagctgattctgccagtggggccggggacagaagtgggtagggagggtgaaatcatggaggngggcctggggagggggctggagcgggagagggtcagggtcctgcccatcagagtggggccgcctgcgtcctgcacactctgctgtcaggtggggtggggggcagctcttgcctccctgtgtgtgtgagacggtgtccctcaccacctcccagt

SEQ ID NO: 325 - DNA, 396 bp, Homo sapiens
  Genbank Accession No. AA149586
tttttttttttttgataacaattgtggttttattgtgtccaaccaatgcatcaataaatgaacttgaagcccaagcctgtgtgtgtcctaattccactcacccagccccgggcacctgccccactcacctctggctttgagaaggggcgtgtgtcggtggttgcctggctgcagtgtctcacctaggctaggtgtgcaccttagaagcacaaagcgggcacagttgtgggtaataagcttactctgcaggccgctgggtgtgtgcccaccctcctgagccccgaaagaggacctgtcagctcctgagaggctgctacgggtttgccttgttctgttcaggcatctgaggtaagaaggaggggccagaggagcaccttgtccagccttcaccatgag

SEQ ID NO: 326 - DNA, 315 bp, Homo sapiens
  Genbank Accession No. AA149889
  unsure (1)..(315): n = a or c or g or t
gggatgggaaaactttattaggtttggtttccagcttcggccacgcgggctccgcnacacagaagctcgggtcacggggcgccccagccgccctcctcgtcgtcctccacgtcgaggcccgggatgccgcggatctggcgttgcagcgccctcccagcaagggcacggcgccctcctcctcctcctctgggggcggcggcggtggcggcgacacggccccgggggatggctctgggggcacgggaggctgcncgacacgccctctgcnccctccgagatccctgccgcttcgccctgcgccccctcgtccagggc

SEQ ID NO: 327 - DNA, 344 bp, Homo sapiens
  Genbank Accession No. AA150053
  unsure (1)..(344): n = a or c or g or t
gagcaggagctgggcctttgagggccctgctccaaccccaagctgcatttatgatataacccatcacagctggattttaaaaatacacaaaaaaatatataatatacattataaaacctaggtggggtttggaggtggcctgagcgatatgcaaacagtgaggaccttcaggaagctcgggcagggtcgggatgnngnagggaaggggcacagtacttcatatganactcataaatacccacaggtggctgctggacaggcccagctggctctgggggcctgggtgtttaagaagggacagcaggttgaaggggttaaccttcaagtcccagaaactggggtct

SEQ ID NO: 328 - DNA, 416 bp, Homo sapiens
  Genbank Accession No. AA150205
gtattattttgttttttttttgtttttgtttttgttttttttggtctaaatagaaaaaaggaaaaggagaaagtaaattcttagggccagacctcgaaatgccccaagtgtccaattggcagctatagcatttgtgaggaggttcctttgccctcagacgagtagtttcaacatttcagtgaaaacaaaggttgcagaaagctgaaaacccagatcttgaaggttgctgtcatatatgtgtttgtgtttcttatattatttccttttgacttcagttttgcatcccaaatatgtatggggtggcattttaacagtcaatgagtcaaacagtcaaaggaggacaggaggggagccagctggtaggagggagcagcaaccgtgtgtggaccaagcgccatttttgttttatagacgtg

SEQ ID NO: 329 - DNA, 504 bp, Homo sapiens
  Genbank Accession No. AA150284
ttttttttttacaatttccttatttcctttattttaatgtgtcaaaaaaacacttaaagatattcttgtaaatacatataagctgtgtgtcaacattcagtactatgcaaatcatttttcaatatgacaaaatgaaaaacttacacactttagggtagcgcttaatacttatctttgaaatctattgctgatgctaggtctaaagagcaatgactcaaccagaaaaaatagtaaaggctgccttttcctttttaaagtgcttattagctttatatccaaaaacaatggtttttacaaatacataatactgaaaggtgctcaaaaagtcaccacttacagaattgaacatgtcattttctaactctgcacatgtaaacttgttttatctgcattaatgaagattgcttcaaatggctctcaatcatatgcttcaaatcaagacagtgctaagttccagcagcataaacagtgacagcaggaccaaccccagcacattttcagtgg

SEQ ID NO: 330 - DNA, 206 bp, Homo sapiens
  Genbank Accession No. AA150776
tagggtttgtggcacataatttgtttaatccagattggatacatcaggtacagcagtggcacacgactcaatactgtaaatgatatacatgttttaacatatgcactacagtttcaaaagaagacgacaggaaactcaagggtgttttttttttttcatagaaagttttcatgttttatcttcctgcagttttgtacagtatattt

SEQ ID NO: 331 - DNA, 460 bp, Homo sapiens
  Genbank Accession No. AA150891
caataacataagagtcaggagagttgggaggtatgtcctagggatgtgattgactcttgacatttaacaactttgaacaactgtgtgtaaagtcacagacagaggaagcaaggatttttgttatcggaggacgtctctctctctggttggaagtttggtgcttgggtgcatagtcttccagagctgagacaggaaatgtactgtgctgagaaatgggccccttgccagatgctcccctctccttcctctctgcgaggcagaaagtcagaaggtagagattgctggcaaaactgtgaagtcccaccctggggtctcaaccccaactccactgaagggcagcctccctgaccgtgtgtgactaaggcagtaagggtggccggttgatggcggccgggaaaccgagttttcgaaggttcacatggccaagtctggcttctgattctgctgccctgcaaagaaa

SEQ ID NO: 332 - DNA, 438 bp, Homo sapiens
  Genbank Accession No. AA151182
  unsure (1)..(438): n = a or c or g or t
ttttcaagtagangtatttttatttnaaggcaccntaaaatgntgatntctctaagaaatacctntccttccgtgtgtgaaaatccttgggggaaaaaaaatcccacacggtgttcttggccatcaggatcatgaaaacaaactttggtgaatgtgagcaactgcgccagacaggacacaggttacagggcctgacgtcactaacggtaactgacaatcttggaatggaccctactgctgatgtttcaaaaggacacagaggtgaactggtcacttctaattaagaagagccagtggggtgggggaagctgaaaaccaaaaatccacgtagacatacgtggcagtngtgaacgtctgtcctccccttccttctcctcacttcctctcctcctcctcactcaggntgggtattctccngggtgtgcggatgtcagctgc

SEQ ID NO: 333 - DNA, 426 bp, Homo sapiens
  Genbank Accession No. AA151210
  unsure (1)..(426): n = a or c or g or t
tttttttttttttctggatgaatacatgttctggtcttgttacaggttctggtaaatcagatggagaaatgttgttgcagaaatgtcagcaaactttacagcagtagttcacacatgcagctactatacattcattcattgctattttcctaagaaatggagcaacctaggagcttatgctacagtagattccaatgaaccataatgactacttcaagaacaaagaagcacatncaaaggtgtgatatcttcctgttggtttgagttttcaaacctgaaattctttaaaatacatttctgggattttatttaaatattgatgcnacacacctaaaaagcagtgacttcttgggtaaaatgtaatactgaaatggaaaattgtcttttcaaaaaaataagaagtgtggtttggaaattccccgtgcc

SEQ ID NO: 334 - DNA, 412 bp, Homo sapiens
  Genbank Accession No. AA151243
cacctttcttttgtttatttatattctttagttttgtgcacactttgaggaattgatttaggacaggttcatactgaaaaaaacctcagctgatgttatctgtgggggctggggagggtgtcagggacatttggtggctgaggagagcgcgtcactgctattgaatagctccatttaacaccagccatgtctccgcgtctcaggcacttctgtgaaatgttctcagaaccctgtggtgactgcggcacacccggcaggccttgctagcacacgccgcccactggcagggcccggccaccctggctgttgccattctttcgtagggttttgttcattttactatttgtcatttttctaggaaacatctgtttttgtaaaacaaacaagggggaatcaagtattttaaccacaa

SEQ ID NO: 335 - DNA, 400 bp, Homo sapiens
  Genbank Accession No. AA151428
  unsure (1)..(400): n = a or c or g or t
cagagagaaagtgctttatcagccgggctcagcccgcacacggactcgccaggagtaggtggtcagcacgcgctgctggcggcnaccacgcaggtgtaggtgccctcattgacggcgttggcgatgatgctcaggtgcgcctcgcccagggccaggtagccggggtaggagaactccaggggctcctggtccttgtaccagtacactttccctttcttgtggaggatcttctggccgcagcggaaggtcacgttcctgccctcggnaccaagcctggttttggtcctggggggcggtggnggtggttggccaccgtggggaaaggggaatttcgtagcaagaaantccgcaagctngcttgggggcaaaaagcttcctttccantgaagncccgccggga

SEQ ID NO: 336 - DNA, 333 bp, Homo sapiens
  Genbank Accession No. AA151435
atatttcccaccttttatttccatcggtatcatccgtttaaaaagaatgacaagaagattcccatcagtccaaactggaccacccacactttgaaaaagttggagcatttcagccggctccgcatgatccatcctgtcttcagtcagtgccttctggaagggagggaaagtcttggatgcacctggcactcaatccactcggcgcctggctgctgctgcggtcctggggctggaaggaactcccactgggcacacatctacagaggagtgcgtggcgcagttgaggacggttactgctggagccgacacacagcgaactacatacttttagaa

SEQ ID NO: 337 - DNA, 631 bp, Homo sapiens
  Genbank Accession No. AA151676
  unsure (1)..(631): n = a or c or g or t
ttgggattataattcatttattcttctggccctaaaggaacttttaacgattgaaactgagtcttttcagttggagccagggaatgaatctgggtatgtccaaatgagagggtctttggcaaaggcactggtgaatttcaatgggataatcaaaccacccctaagttggcagctgacccagaactggctgttgggctggagggtaggccagggtccttatgtgttggatctgatgtccggagaggaggggctggtcacttattatgcccctgggaaggcctgaatccggctgctggtgaacaagttcttgtctagctgcctggacagatggcaccaggaataaaaaggaagaaagtcaaggcagtggaaggaggaaggtcagggagcggccagagaatcaaggaccaggcaagagaagatggatatggctgaccaggggcatctttacacattgaactctcaggtcacaagtatgctggtctggggagaaatccccatgcatgcgggggagcctgcatccctgagacagatgaggcaaaggagcatcccacacgtgggaaacctgctcagatgaaatgtttccaggaagttctaagctacttactggaccncagganttgggagactacca

SEQ ID NO: 338 - DNA, 565 bp, Homo sapiens
  Genbank Accession No. AA151778
  unsure (1)..(565): n = a or c or g or t
ttttttttttttttttaataaaaatctttatttttttattaaaaaagaagtactttggtagctatttaaataagnngggggtgggaatgaatgtcgagatacgagcacctgcatcttttagtcaattgtcagtggagtcggtggggtgctaagtgttctgaactgaagtaggtgcactaaggttccaagctccctgcaaggatctggacgggaggaaagcagaggccctgaagggaaaaaagcctgcttcccaatacttattttttattactgtacaaaaagcacactctccctctttttgtctctcccaccaacggcacccccccacccccaacccaagaggactatacatggagtgcagggacagagttgaccaggaggcctttgtccggcaccctgcccacaggctgagctcagccccaggccctttcaggcatctagacactcccatagcctggtcangctggggcaagggagatnccaggtcacacatacttccctggaagagttggacttaggggtaagagccgggtgcacggtanccagncttgctctcattcccang

SEQ ID NO: 339 - DNA, 628 bp, Homo sapiens
  Genbank Accession No. AA156187
  unsure (1)..(628): n = a or c or g or t
ggattgcaaaaatttattaaaattggagacactgttttaatcttcttgtgccatgagactccatcaggcagtctacaaagaccactgggaggctgaggatcacttgagcccagaagtttgaggctgtagtaagcttcaaaggccactgcactctagcttgggtgaggcaagaccctttcaagcagtaagctgcatgcttgcttgttgtggtcattaaaaaccctagtttaggataacaggtctgcctgcatttcttcaatcatgaattctgagtcctttgcttctttaaaacttgctccacacagtgtagtcaagccgactctccatacctttaaaaggtatgacaggaactgtcttcatgtccttacccaagcaagtcatccatggataaaaacgttaccaggagcagaaccattaagctggtccaggcaagttggactccaccatttcaacttccagctttctgtctaatgcctgtgtgccaatggttgagttaggcttgctctttaggacttcagtagctattctcatccttccttggggacacaactgtccataangtgctatccagagccacactgcatctgcacccagcaccatacctcacaggagtcgactcgtgccgaat

SEQ ID NO: 340 - DNA, 668 bp, Homo sapiens
  Genbank Accession No. AA156243
  unsure (1)..(668): n = a or c or g or t
accacctgactcagacttctttgtcgttgttttatttaaaatgttattgtctctgattagaaaatacagtcatgagggctaaaaactgaaatgatgtgaaaaggcatccattaagcagtgttgccccaccaccctttccatcagtcttgtctcatggggatggggaaaatgaagacagaacgctttgccttgctttgcaatccctcctttgaaggccttctgtcccaggaagccaatgttcatttgatgtggaagagggacctgtgtttaaccagaagctgtcctccctcatccctttcccatggcttacacgcagaagggagaggagatgaccagaggagaaatcaggggaagaaaaggcaacaggggaggcaaagggaaaggagaggaatgcttaaaatatacagtgaaatttgagtaggattctctactcaaagacttctctgggaagtgtccagaattgaccacacaggtgctgacggtagaaagaacacagacccanaaccctgatctagttgcattaactccattagccctgagttccctgtaaaatgaagactgtngaggaccactagaggattctgtgacttctcaactctaaaattttggactggacctcgtgcgaatctggctcgaggcaaattcctatgtggcgatnaatcgnacag

SEQ ID NO: 341 - DNA, 350 bp, Homo sapiens
  Genbank Accession No. AA156336
  unsure (1)..(350): n = a or c or g or t
ttttttttttgttttttcngctttatcctcttctttttctnctactttttcttcttgcgagggtcgagcaatttgctgctggtttctgcctctgcgtttcccanaattccttctgacgagggctttataattctcatttttcttggttaaatagtaatacaaaacacaatcaggaacactcttcctctccaagtatgatgcaattagtccaaagttttttggatgctggataaacttgtccttaaagatcnccttttcatggtcagtccaaacattcatnaactgcctatctttatacactttcataggggtcctccaataagcccantcatggtaaatggactttgact

SEQ ID NO: 342 - DNA, 434 bp, Homo sapiens
  Genbank Accession No. AA156450
  unsure (1)..(434): n = a or c or g or t
ttgcttataaaaaccattttaaattaaaaaagggaggaagcatcagtgcacacagatggggacacaggggcagagggccagcccaaagtacagtgtggtcaccccacagcccagtggacccagggcagactcccctcgcagcacagacagctgaggcccgggtgctggttcctctaggtacagctttggtccttgtgggctcagaggtctgcctttcggaaacttgctctgttcaaggagttcctgaggccgggtggggtgggtgccatcagctggggcaggcgctgggtaagcaggggctgcaganctcccgcagcggcagtagttgcgctccagctcacggtggtactccttctggtccggcccaatcagggctttatttttccgcagcgcatcctcacatttcttgcagaagtccttgaagccctcgtgcc

SEQ ID NO: 343 - DNA, 452 bp, Homo sapiens
  Genbank Accession No. AA156460
tttggttataaaagattttaatatcaaataaaatgtacatgatcaaaaggctttgattgccatgtaaagcatagtttccaggttacatcaagtgattttatcttctcccatttcaaatgaaatgttgaaagcacaaacaatctgccatgaatgataagaagcaaaggcagcacatatcatctgcaagtttcttcccaagctataaaatatcatgttcatatttttcctgtttgtgatcccaaaacaggcaatattttcatttcatccactctattcttatgtatttgaaaagcaggtgttatccacctaccacaagagcactgttcaccataccagttgaaggaacccaacttggcactgcattttgggcaaagaagctgtccatccatcactcccaacaaagcagattccatccactgtacaggttcaatgaaataagatgtacattgagg

SEQ ID NO: 344 - DNA, 457 bp, Homo sapiens
  Genbank Accession No. AA156565
atagtaaatatttaattgtttccatcagcaattccagcacaagttttcctggatggtaggcagaatcaagctacccaagggttcatgatgaggtatgggggtcactgaggagacccccagagtcactgacccctcccgccacctccacacaccaggtggccctgcagaatgagggttgggctgatagaatgtcaattaggggagacaggatacagggtgagggaacagggtctagcttgtatatttgcctgcaggaaggagggagggcaggagagactctgcatagaaggactggaactacacatttaagttttcaaccccaatatgcagggggaaacagccaagccactctccatctgtctagtattaggaacctctcttcaagtggtcttttgtcatctctgttcttcttcccaattctgtattccagattccaaattctacaattgaaacccaa

SEQ ID NO: 345 - DNA, 424 bp, Homo sapiens
  Genbank Accession No. AA157112
  unsure (1)..(415): n = a or c or g or t
tgtgttcaaagagtgagattgatttctttttattgccatcttaacaaaaatacttcggaaggcaatctttgattccagcatcggaggccgggcaattccaggcaataattaagccatcagntgtttggacaggagagtgttcagtttgagggaagcaggaacccccaaagaaccacagaatggggagatggagccaaagnacaagggacattgcagtcaccttccattctccctacgtgggacaaagcttggcttgggtttacaagcagcgtccaggaacagccttggaaggcactagatgctgcaatcctcccagctcccactatggctgggggcaggatggggagggtgggggggttgttgggtggaggggttggctgggggacttctgctgggggtcagcttcaggttcaggggaaaaaaa

SEQ ID NO: 346 - DNA, 384 bp, Homo sapiens
  Genbank Accession No. AA157401
gaagatccgaggcattgtggaagagagcgtgactggtgttcacaggctgtatcagctctccaaagctgggaactctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgcctgtgctgctctcaaaagctcttggagcaattgtctacattaccgaaatcgaccccatctgtgctctgcaggcctgcatggatgggttcagggtggtaaaagctaaatgaagtcatccggcaagtcgatgtcgtaataacttgc

SEQ ID NO: 347 - DNA, 307 bp, Homo sapiens
  Genbank Accession No. AA157520
  unsure (1)..(307): n = a or c or g or t
ccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccggtcctgnctcactttgcagttggcactgggttggggaggaagagagctgatgagtgtggcttccctgagctggggtttccctgcttgtccagttgtgaagctgtcctcggtgttaccgaggctgtgctaaganga

SEQ ID NO: 348 - DNA, 444 bp, Homo sapiens
  Genbank Accession No. AA157799
  unsure (1)..(444): n = a or c or g or t
ggggttcactcaagacctaggctacagcanggtcaagtgcctgctttattcaacaggaagcgctcaagtgggactcaccccccacctttcacagtgtaaagtgaatagggagcaaggcaggaagctagaaaaataatgcatggatctagacaattcagaaaaacccttctaagtcagcttaaggccaagactggtcagtgtgagagaacaaaagaggtgacagaaaagccttggnagcctgagccatgatgggcctagcggaagtagttgggacattcgtgagcaaccaaatgccaggcttgattaaaggcatccacgacagccggctccaggggcccttcctctgttgctgccaagttctgctccagctgctccaggctggacatgcccaggatgaccgcgtccccgtgggcaccctgcagctgtgagtggtggtacatccac

SEQ ID NO: 349 - DNA, 441 bp, Homo sapiens
  Genbank Accession No. AA157818
  unsure (1)..(441): n = a or c or g or t
ttttgtgagcaacaaggctgtttatttcacctgggtgcaggcgggctgagtccgaaaagagagtcagcaaagggagatggggtggggccgttttataggattagggaaggtaatggaaaattacagtcaaagggggtttgttctctggtgggcaggtgtggatctcacaaagtacactctcaagggtggggagaattacaaaggaccttcttaagggtgggggagattacaaagtacatttatcagttagggtggggcaggaacaaatcacaatgttggaatgtcatcagttaaggctgtttttacttcttttgtggatcttcagttactttcaggccatctggatgtatacgtgcaaatcacaggggatgccatggccctggcctgggctcanaggcctgacaattcctgccttcctataattaattaggccaatnaaac

SEQ ID NO: 350 - DNA, 427 bp, Homo sapiens
  Genbank Accession No. AA157857
  unsure (1)..(427): n = a or c or g or t
tttttttttttcntcccttgnacnataaatttttattggcaggtcagganaagagcngggggtaagggtcccttccttnccatccctctacncanaagacaccctccanagganagnagaagccccagagcctgctgcctcagaggaccttggaggcagacaaattgttgtagtgatcttcctgtccctcgagcaggctgcggttaggtggcaatctcctgctccagccgcgacttgatgtccatgagccgctggtactcctgattctgccgctcactatcagctcgcacatcgcccagctgggttcaataccgctgatcagcgcctggatatgcgccagtgggctccaaagcgcgcctccgtttctgccagtgtgtcttccaaggcagctttcatgctcagctgntgactgcagctcaatctcaag

SEQ ID NO: 351 - DNA, 614 bp, Homo sapiens
  Genbank Accession No. AA158234
  unsure (1)..(614): n = a or c or g or t
nggctgtgataggtttattcagaggaagcactagactctggggtagctcacatgggtaagaaagacttccaggagcaggcattgaagggttggcaccctgggtgagtgtccaaggtcagcgagagtcacttgtggaggggacggaagatgacctggctgatctggccagggatggtgtagaagaccaggaggaggaagacggtgagcagcaccagtagcagcagcaccagggtngcccagtaccggcncagatgaagaagacaaaggccttcagcgggttcacaaaccagttgaaggaagttttggggcggctgggtttctccagaaggctcttggctgcttccgccccttccccattggccgtttctcgggcttccttccacagtcaagcaagctcaaactcttgcctccaacnttgcccgtgaagaatgtacacattggcanccatgtctgtgaactcccangtctttttggccggccttcctcctcctctgctttcgcttcttcttgcaagcctgagcctcctgngcttccggtcaagtccttgctccttaagttnaataacggcaacagccctcaaggggggaagaaacagattgactcngccggcccat

SEQ ID NO: 352 - DNA, 416 bp, Homo sapiens
  Genbank Accession No. AA158795
  unsure (1)..(416): n = a or c or g or t
gggagacttaactggtttaattgcttagccctggtgcctcagccacctctcatctgtagggtgagactcaagtccaggcaccaagacacaccagcacccccaacaccatgcggggatcattggcctgaaacttggccagagaaagctccagtcctgggcctgtaagagtgggcgctgggagtgtctgaagccggcacgtgtcccctgcgttgtcggcccttgcaggtgaagtgtgtgtcgttcccccactttcccccgaatggcacccacggcctcctgctggagcccctcccgggnccccctcagggagcagaactctgcgtgtgttgcgaggttcaggcttgggcaaggcttggaagttccaggttaancacatattaaaaaattaatacttccatgcaattggtngggtgggg

SEQ ID NO: 353 - DNA, 392 bp, Homo sapiens
  Genbank Accession No. AA159025
ttgatgtctagaaacatcttttatttgggtaacaggtcccaaaacaggtcagttaataaaatagattctaaagaatatgtccctatgcacagccctccctccccaaaaataacgctgggggtaggcattgcctttcccccttgggctcctcgggtgtatttaaaaaaatgttttggcagctcagtgtttatcatctgggcatgggacaccatgtccatgtccccatattcctagggtacagcagcagtagatggctgcaacaaccttcctcctaccccagcccagaaaatatttctgccccaccccaggatccgggaccaaaataaagagcaagcaggcccccttcactgaggtgctgggtagggctcagtgccacattactgtgctttgag

SEQ ID NO: 354 - DNA, 424 bp, Homo sapiens
  Genbank Accession No. AA159525
ggcagctcactccaggtttatttcagggcagtttgggggtgggggacaaagacccccctccagctcctaaactgggtcacttttctcccaggtgaaggggaccatcctcatgggatcctatcgatgtgagagctttgtgtccaccaggtgtggctgggtgcaccaaggtgaagggtttgagggctgcacagggacccccagcactgggagtttggcctcctccctcagactggatggtttcccagggttggaaaggggcaggtctcccctctcagcttgggacttctcagagggaggagctgagtgtctcctccctcagacccgcagcccctcaaggtgctgcgatctgtgccaccctctttgaccggtccctctgccctcagactagcggaacaaaattacacctgaaagtggaggagcgggt

SEQ ID NO: 355 - DNA, 445 bp, Homo sapiens
  Genbank Accession No. AA160775
  unsure (1)..(445): n = a or c or g or t
tttttttttacagacgcgggctttattaacatttggtagtgagcacggcccccagggatctgcggggntcgggtcccggtgacgcaacggttaaacctggctcgcgacttagncaggcccttgggggaaagcccggagcctgaggngtggcacggagccacttccggcggctgtgggcggaaaacccaaaacttccgatgggaccaagccttccgtggcttcacacgcaccggaagggaagtctgggtcagccctccctccaaaggagacagcacggatcctctttttngcataggccttgagggaagttacttccgcccatattcaagatggctgcccagggcnttgggaacggggtggagtttcgggatgtggagcgaaggtcactgggagggggcggnttcccctgcccagttccgatccaccaggactggaagactcgcgt

SEQ ID NO: 356 - DNA, 432 bp, Homo sapiens
  Genbank Accession No. AA161043
acattgtaacaggtttatgcattttgaagtgccttctacacatccacccagaggctctgctgatttcacttatgcccaggctataaaatgcctttctctcatcccccagtagagcactgggatcaccactaggcctagggggcatatcaagggtttaatagactgggggaatgggcaacagaactggctaccttagaggctctggaatgccccccacccatccacccaccaatggaaggaaagtcaggcatcgctaaaaggagtggtccctatctagccccaagtctggagcagaaagggcaggtccattctggcccaagtgacattgttaagatcctgtcccctcccccaatcactgctgcttgccagggtgcctcttcacagttcccatgtggcagcagtagtggcagaggcagaagtggacttattgta

SEQ ID NO: 357 - DNA, 365 bp, Homo sapiens
  Genbank Accession No. AA161292
gcaacaattcatctttatttcttattttcctctggagatgcagaatttggtatatttcaccccaggtatatttgggatagttggctcctcgctgggtcaggatggctgggtgccttctcccctggcatggttctcttctctgcagggcgaggggcagggagctagtagaacctcgcaatgacagccgcaatggagacccaatggagcccaggatgaacttggtcaatccggagagtccagttgctcccagtgactgcagagtagccacaaggtgcccgaggaactccacccccattggcaatggcgccgcggacatcatcttggctgctatggaggacgaggcgattcccgccgcagtgaagccc

SEQ ID NO: 358 - DNA, 443 bp, Homo sapiens
  Genbank Accession No. AA164252
  unsure (1)..(443): n = a or c or g or t
ttaaaatagtcacttttatttcttagcaaaactatttcctccgtgagggttatttacaacagagaaaggaaagaaggggtcaattcacagcgacttggagaggctggaggggctcgtgggaggcccgaagggtatgacagacacacttcacacaattaactggaactgctttttccggtttccgacggggacgtccccagaggactttgatggggccggggcgcngntggcaagggaactcgcacaaaccacccgccctcctggntgggccccccggtcacccgcgggtgagctcttgggagttcgggctcaaggaccccggaaggggngttctggcaggtnccgacngcagccncgggggacaaggggcaagggccaangggcagggccgtggcgcattnaaaacaaccgagggggaatcggncaataccgagggggggcgg

SEQ ID NO: 359 - DNA, 333 bp, Homo sapiens
  Genbank Accession No. AA164586
tttttttttagtttaattctttatttgaacatcaaataggttgagaaaattgtttacaggtgctcgagcatcccgctggattctttttcaaagtgcaaaagaggtttacaagtgtgtttcattaaacaaagcaaagctgcgacaaaaccgagtcacatcagtaatagtatgcatcggcaaaagggcatattaatccatcaaacacaatttggcatttgagccttttcccataaaacaagagctctacactgaagagtatgtagtgcacaaaaagcattgtttatcacctgtgagagaacagaaactggcataatgtcacttattaattcaagt

SEQ ID NO: 360 - DNA, 574 bp, Homo sapiens
  Genbank Accession No. AA165526
  unsure (1)..(574): n = a or c or g or t
aataaattcaaagtcttcatggtgttcagagtcatagtagtccatacgcttctttttcttgttgtaagctgcaactcgaaagggaactatttccaaagtgattaaaccaggggccatcgtcagcactttggcaccatgacttggctcataaagatccttccctgtttctggatgaggcatgccagcagggtctcgtccaacaatgtaaaagttggctcctgcaaccatccgtgctctgcaatgccactggacctcagttggtccagcatacatcatgggagatgggaagatggccaccactgtcgtctcaggattcagaactccttcctccaacactgcagcatgctgctttcatacgccacatcaaaggaacatcgtcatcctttgtccagccacccagaggggaagngaggaggacagggcgccggtagcccctctctagaagttgcttatgggtatcctgcattaacagggcatgtccattgtgcactggggtgcgtagttgaaatgcaaagacagcatcagcattcaaaccttnaatttctggtttagctcagtaagaggtaaacgatnt

SEQ ID NO: 361 - DNA, 473 bp, Homo sapiens
  Genbank Accession No. AA167550
  unsure (1)..(473): n = a or c or g or t
ggctggagtgcagtggcatgatcgtggctcactgcaacctctacctcccgggttcaagcagttctcctgcctcagcctcccaagtagctgggactacaggcacttgccaccacaccgggctaatttttttgtatttttagtagagacggggtttcaccatgttggccaggctggtctcgaactcctgaccttaggtgatttgccggcctcggctcccaaagtgctgggattacaggcgtgcacncacgcctggccaaaaacccttgctttttaacttcgattgacacttaacaaaaatcctccacatcccactttttgacagtttacattaaagcctgtggtctgaatatttgttttacttagagggggacctttgggcaacttatttgcaaacacatctaaccttcctgggcttattccacagtattttcatagacctgtatatattagacatcacacttggcctcgtgcca

SEQ ID NO: 362 - DNA, 300 bp, Homo sapiens
  Genbank Accession No. AA167565
tagaccacaccaaaacatgttttgtttaatgttgttaacttttgtgaatttttgacccaagcaaactttggttggtaaaaagtgcataggtggaggtggggagggcaggaagatcccagaaaacctttgtcctcagaaaagcaggtcaggggcctggcacagtggctcatggctgtaatcccagcactttgggaggctgaggcttgcagatcacttgaaatcaggagttcgagaccagcctggccaacatggagaaatcccagttctattaaaaacacaaaaattagccggacatggtgg

SEQ ID NO: 363 - DNA, 629 bp, Homo sapiens
  Genbank Accession No. AA167708
  unsure (1)..(629): n = a or c or g or t
ttttaaagcttattagctcatttatcttggaaacagtagttaaactgaataaaaaccaaggggcaatataactgctactggttgagtcatacagtgatgtgtagtttggaaaagaagacgaatgatagatattgagcccctttaggaaatgttgccagtatttgaatttggctttcatagttatctcttgcacacgaagtagagtaccatggctgataacaagaggtcaaatgtacaagttgctctaatatggcctcaatgaggaccagcttcaaaacccgcttgctgataattcaggtattcatggagggtcaagacttcaaagtcatgtacttcaagtaccagtagagcatctggtgttgctaagggagtctgtcagtgtagggtgcatagaattgttctctgggctatatcccattctaggaatcactggatatcctctggagtggagggctgttaatctaggttcacttgacacctctcagcaaatgatcattccggggtcaagacatgcctgtctctgcactttctaagttcacacacagtatttctaagaatgttcagcatctactgaacatgaacgtgctgagtggaggtcngaaagttggatgccatcaggtcaactattg

SEQ ID NO: 364 - DNA, 347 bp, Homo sapiens
  Genbank Accession No. AA169837
tttttttttttttcagccttgacagcaacaccctttattcagcaccaggaatacccttcgcacagaaccagcgagcttcacgtgctcagcttccccgcggaaatgctcacaggatgctgcgggacccccggcgtgccacacgatctagtggtggtgctgtctgaactggagcccacagtaaccgcatgtgccggtttttgtttctttgtccaagtttatatacacttttgggtggccaagagctcccccgccgccatcgcacgctatcacccgagtctccacctcgctcacgggctgctctgctatcaaatcaatggcaaagttttcattcacctctttctgacgac

SEQ ID NO: 365 - DNA, 415 bp, Homo sapiens
  Genbank Accession No. AA171529
tttttttttttttcatctttcaatatcacagtcttttaatgtcaatgaaaacaataatttatgaattaaaacatctttttaaacctgacaggaaaatatataagcacaatttctggataaagaaaatgaggtgcagttctcagggctttagtacttcattttaaacagtaaacacagtaccaaccatcgttttgattccagtgaataagaagttaagattaaatttattaatcaactttgaagtctgaaaccgaaatgatcctttaacagcattgccaaataaacaggtcagttctacaaagctaatcataatgccaaattttgaccaaatgataaagtggctctgttaccatagtaccagagtctgtctttttgttgggtttctgtttgccataacaaccaaggattgaattac

SEQ ID NO: 366 - DNA, 471 bp, Homo sapiens
  Genbank Accession No. AA171694
  unsure (1)..(471): n = a or c or g or t
tttctattttatttattttattttttatttccttccctcataccttgcccattccctctgaatattaggtgtgatgtcaacagcatgttagaaggatcaatgggaaggcaatgattgaaaacatttcaatgaaccttaatagtgttcctttgaggagcacccaggagaatatctggtcatagatctttttttaaatgcagttttataaaaccctaacagcggtgatatcattagactgtatgaatcagttttattacctagtgtacaagtgtcagtcatgtatcattatatagtctgttgatctttccatttgcaaaanattaatagttttcccccacanatgtacaaagttggtatgcttccagtcttcctttaatggtttatagtcattcccaaaggtaacattccaattttacactttcacatacattggttaaggaatcantggggtttttccccctttttncccct

SEQ ID NO: 367 - DNA, 371 bp, Homo sapiens
  Genbank Accession No. AA171760
  unsure (1)..(371): n = a or c or g or t
tcagccaatcacaaaaaacagactttattgaagtatttagcactaaaccccacacaattccagctctgtagctgaggacacagccacttggcaatggcaccaggtgttatacaagaccaataagttaatgtaaaggacgcttaggtgtggagggccagtgctcagccgtctcctggctcagaacaaggcactctgggctccagttaggacactgagaggccagggaaaccaacatgccctggagaaaggggcttagagacaaaccggaaaagcacagcatccaagcagggtattcacgcatggggggcagagtaggcccaaaagttgggggttgcctgatgcggtaagagcacagttgagagnaattncca

SEQ ID NO: 368 - DNA, 298 bp, Homo sapiens
  Genbank Accession No. AA171939
  unsure (1)..(298): n = a or c or g or t
ttttttgaggcacctgtgggactttattaggtaaacagaccccagctccagccacaggttggaccggccagctgacagtgcggcctcagacacccccgccaggttccctcctccctcctctctcagggtcaccagtgtgtgaaagatcggggcatgccggccacagggggaagcagggttcaggctgccccacctgggtctggccctggcaggcgccccctcacctggctctgctgtggganccgagaacaaagacatnacctgcctggctcctgctgccccggggggtcagcnagca

SEQ ID NO: 369 - DNA, 424 bp, Homo sapiens
  Genbank Accession No. AA172076
tcttattcagtctccgtagagactgtcaaaaattgccagcgctgattatatttcaagtcatcacggtggggtattgggaaaatttccaattagcaataatcgcgtctcggataaatctcattggctacggtactgccactgtgcaaagctagcttgacgtaggactttgatggtcatgtataacacctcacaggggcagaacctcctccatccccgactccaaagactcatgtaatcagtacgcaagaaagttcagagatgagacctctggttgtattccacctttgggacatgggggatgtctttagttcaaagtcacaaataaatgcaggttctacaattcagaggcttcatatccctgctggagtattacatgtttattcaggatggaccacttttcttagcaacagtttctaaacctttg

SEQ ID NO: 370 - DNA, 201 bp, Homo sapiens
  Genbank Accession No. AA172372
tttttttagtctgaaaaacataatctctataatcatttaatttttctttttggaaaatgtatgtatacatacacacagtttccataaaaaaacatagatagtaaagctgattaaaatcttcctgtcctattggtaccagcacatgaagcccttctacaaaattcctgacggactgggaataaaaattcctagtgacagccc

SEQ ID NO: 371 - DNA, 374 bp, Homo sapiens
  Genbank Accession No. AA173430
  unsure (1)..(374): n = a or c or g or t
ttaagacaaacataacctttattctctctcaaaaacccagagaacagggcctggaaccatattcgttaatttaaccagaatcagaatactttaactttcatagtctcatttaaaattttatagcaatatactgaccattctaaaaataacaaaatacatgttgctctcaactacatagttaaaaaaggtagtaaattctcttacccaaaatagaggaggggtgggctagtgagctgctcaaacatttgtaacaaataaaaatgtatctatatacatataatgatcatgttttcatagcctaaaatcaccattaacaaaatctaataataaaattgtgtcgtgttcaggagttgggaagccaacacattaaattn

SEQ ID NO: 372 - DNA, 340 bp, Homo sapiens
  Genbank Accession No. AA173505
ttgggattgtagcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaa

SEQ ID NO: 373 - DNA, 436 bp, Homo sapiens
  Genbank Accession No. AA173597
  unsure (1)..(436): n = a or c or g or t
ctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatataccagtacattcctaagttggaatccgtttacctcctgcctagaattttaggtgtgagattttttggttcccaggtatagcaggcn

SEQ ID NO: 374 - DNA, 419 bp, Homo sapiens
  Genbank Accession No. AA173755
  unsure (1)..(419): n = a or c or g or t
atttgagaacatttttaataaataatgtgacaaaattacttttctgattattggattttcagtatgcaaaattatggctaaaaataaggggcttcttacatgaacataatgaaaacattaatcacatggattgttcccttagtactgcacgccttttctatggaactttttcaaattatctaaatgaacaagtttggttttggtgaacaccagcctttttttttgtggntcagttttgtttggctttgttttccactggggtcagacctgatacttatctatctatgaataaatgtacatttttttcttcaaatagcaccaattataaaatcaatgatattcntaaaatgacaaaaaaggatcatagaaatctactagtcagagggcatcatttggtccaattggaaagccaggtaatg

SEQ ID NO: 375 - DNA, 254 bp, Homo sapiens
  Genbank Accession No. AA174202
tttttttttggggactataacaggtgtgattgacgaccggggcaagttcatctactaaccccagaggaactggccgccgtggcaacttcatccgacagcggggccgggtgtccatcgccgagcttgcccaagccagcaactccctcatcgcctggggccgggagtccctgcccaagccccagcctgacccagtccttcctcttggactcagagttggtgtgctacctggctatacatcttcatcctccacatct

SEQ ID NO: 376 - DNA, 514 bp, Homo sapiens
  Genbank Accession No. AA176233
  unsure (1)..(514): n = a or c or g or t
tcaggattaagcatgtatttattttagttcagttaaaacaaacatacattgtttcattgaaacggtgtagcactctttgccaacaagccatactagaattgttggcctctaacagtacagtggggatatttacactatatacacaaagttaatacacccaggttctcaaaggtcttccattacactagatcacattttatttcattacactagatcacattttgattactgcattttgaaaatgtattccttatttaaattttaaataagagntctgaatttgtaccaagatttcatgaaaaaatttgatgttgtttattgcaaatacaatttaaacaagttttttttagtgtttgtacacaatttgtcaatttttcaatattcaattttctgtacagggacttttgggacaattcntatagttacataatgngaattcatcnaaatgcagttaagaaacttacagggatatatacacttggaaccccagaccccaacctgacattatatacca

SEQ ID NO: 377 - DNA, 312 bp, Homo sapiens
  Genbank Accession No. AA179004
tgcctttaaaatcattttataaagaatggcacaagttggggtttatgtttactcagatgaacccgtccccttagaggacacaatcccacccccaacccccccaactccacgactgcccatcattgctgttaatccttcaggggagggttcacagctgtttatgaagccaagagaggttctgggcaagatcacagctggggaaacaggcccaggcctgctccctggtgtcctccatgctggagtcagcggtgcccaatgacggggtgatgtgatcacatctgcttccttctccacaacaagagcagggctggc

SEQ ID NO: 378 - DNA, 521 bp, Homo sapiens
  Genbank Accession No. AA179298
tttttcactttacaagaagttcactcttattcatggaggcatcatgctgacaggactggatccaaggaaaatgctagtgactttcccaacttcattccccaatcaaagaggacagtttctggtttgccactggtgagtttgttacacgactaaagttcaaataaaaaaataaaaaccaaaatcttggcagggaagctagagccagaatcaggaaaatctgcttccttgtccccagactccctggccaagcccagctccactaactcatcttgactcgatcaagttcctcatcaagacttgcatctgtaccctggacatctctgctgctcccactggagagtgagtctggagtccctggcactggggctttggtgagggctccatatacacccatggcctgagcaccatgctggtgacatcgccagggttggagggcagtaggatagtgttggagtccttggccagtttgggagaacgcgctgacatactgctcgggcacagtcagtgaagctgctgcatct

SEQ ID NO: 379 - DNA, 366 bp, Homo sapiens
  Genbank Accession No. AA179387
  unsure (1)..(366): n = a or c or g or t
ttaaggatttacttttcttaacaagtgaacaatttgcttctaagcgtcaatgaaaggcaacacctccctctaatggccaaaggaagagagtggcagtaagctggcttttccaatgtgncacacaatccctncnggcnattaagttctccttgttggaaaagaaattaggttgttttgataacttagaaaagttagttttagacaacagtgactttcagctacaaatacaaaatcaaatccatgtatatnaggcttctgtaatcgatgtcttagaggaacatctgctcattttctncaagccccagtcctataaatcaaggcaagtcaagtaattaaagcttcaactattttgggcagctttgcaat

SEQ ID NO: 380 - DNA, 429 bp, Homo sapiens
  Genbank Accession No. AA179787
tttttttttttttttttttttggtgggcaggatcaccagaaagcttttattttaacccagggccagggaggcgaagcttcaatcctgctgcttggttcgggaggcctctgcattggcccggagcacagcccctggggatggatacggccgctgctggaagaggggcccagctgctgtggtgtcagcgccagtcttggcctcattccgcttggggagtcctgttgaccacgtgccccggggggttcttgagtatgagctagggtccatggggtctaactcttcatcctttcggcttactgccttcttgctcttgggatagggagccagctcctcccggcgatggtggcgccgttctttgccctcttcccggtctgccttgtcatacccgcggtcccgatcccgttccctgtctagctctctctctctgtc

SEQ ID NO: 381 - DNA, 444 bp, Homo sapiens
  Genbank Accession No. AA179845
  unsure (1)..(444): n = a or c or g or t
tgaacaataatatctttaatataactgtttttgtgtgcatagaaatcatataagtaaataaaaaaaaacaacaacatgagattacataggtggttataatacaaaagtgagaaaaaagctagtgtctgagtattgcatcctggatataattccctgatatatggtaaagcataaaagagacctatttcttcaggagagtagctgacccacctcagggccatgactgctcttctctttccccacagccttagtactttttgccaaaaggcccagatttgagtaaaggggaacgccgtgagcgtaaggatccgggcataagggctgcagtctgttgagctttggcaggttggtgttcggggaagtaaatttcngaaggaatgggttcctnccctgntgggttgttggtttggttgctgattttccnggttgggtaccaaggcgcta

SEQ ID NO: 382 - DNA, 250 bp, Homo sapiens
  Genbank Accession No. AA180356
  unsure (1)..(241): n = a or c or g or t
aaaaaatatttgattcaagtgcttatcctcttttaagtcaatgaagtagagctcttttttatagacatcacatacacgacacatatttaactacacaagcagaagaaaatgcagtagctgtgaaatttttcgtctgccaatctcctaattggattattggcttccgggtgttgccttttaagagacagggccagaaaaacatgcagctttttaaggcctaataaaatagggcatgantggggnggcaaaa

SEQ ID NO: 383 - DNA, 431 bp, Homo sapiens
  Genbank Accession No. AA181580
taaataagtaactccattgtttttctcttttccaagatggccgatgttatggttttctacgaagtcagtgcttacttagctcactaacagcgctgctgttggcggctgcggctgctgctgtggcaggattttcaatgtggtgtgttttcaagcctcactcactcatcctctcattcccaaacattcagcatccgtgcacactcctcacttccaggtttttcaaaagatgggagatttccagtgggggtcctcaggttatcatcccaatggtaacagatcaagcttggttcttcagtttcctcagttcttttgttgcccatgtagcaagggtttttgctttgttagtcttcgatctccgcccttcagttaacaattcatggatcattggcctagcttctactaatttcagtacatccttcccaaatgctgta

SEQ ID NO: 384 - DNA, 408 bp, Homo sapiens
  Genbank Accession No. AA181600
  unsure (1)..(408): n = a or c or g or t
tatttttaacataaaagttctattttcttgtgaggcagcaacaagtgttcaggtacagggaatacataagtacagcgtaacaataccgattaccattggaaatgctgttttttgagagaattgttagaataacaaaatgttttaaattgcattttaaaaagagttacacagcttccacagagacaaaaaatgaagagttaaaaaaattctattcttaaacaagactgtataaacaaaatgctgttcagggctgctctgctcatcttcaatttggtcagagtagaacttaaagtgcaggagttaagcattcttaggctttattttgcaaattccggcccttccactcatccgggttttggggccctcaaanttcccaangccttggggntggatcttaggtttnccatg

SEQ ID NO: 385 - DNA, 401 bp, Homo sapiens
  Genbank Accession No. AA181705
  unsure (1)..(401): n = a or c or g or t
aagataaccaacaattactttaattcataaatgtatatacatagattacataaagaaattaagtacacatgttgcattttaaaaatgtgtctagcaggttattgtacaaaattaaaatgaatttaagaatacattttaacatttttaaaattagttaatcatatatttatttatctatnttatttatttatntttgagacagagttttactcttgttgcccaggctggagtgcaatggtgtgatgttggctcaccacaacctctgcctcccaggttcaagtgattctcctgcttcagcctcccgagtagctgggtttgcagacatgcaccaccatgaccgggctaattttgtatttttagtagagacggggtttctccatgttggtcaggctggtccgaac

SEQ ID NO: 386 - DNA, 148 bp, Homo sapiens
  Genbank Accession No. AA182001
tttttttttttcagcttaaaataaatttattgtgcaatacaaaatgtaggcatactggaaaataaaggtacattattaaatatacaaagcaaatgaaagctaaacaacacaaatgttttcatccaaacactaagataaaatgcacaac

SEQ ID NO: 387 - DNA, 479 bp, Homo sapiens
  Genbank Accession No. AA182030
  unsure (1)..(479): n = a or c or g or t
atcatcataaaaaatatttattataaaaaattatcacatttctctgtacatagcataaagacaaaaacacaatgtatacattaataaattaagtgggcctgagtattcagtatccatctactagaatcctaaagctcttccccagatttcacaaaggccaatgtagattatttctattttatcaaagttcatttgcacagttggtgtaattgagatactaacatttcttttttctagtgttttaaagatagttcacagtatttgagttaattaattaatcaactgatttaaatctttggtaaatacaagtatttacatgtaaaaatgtttagctcaaatttcagtaaaaaactggaaatgaccaataacctactgccaactgttttggtataatccagaaatgcatgagccggactcccaccattaagaaatggcactgtcnaggacctcngatgataaaactggaatccncaaaaaat

SEQ ID NO: 388 - DNA, 401 bp, Homo sapiens
  Genbank Accession No. AA182568
ttagaaatcaggtttttttttatttaatacattctaatcaaatagtaacagcagtaaataaacactttgaaaaacaggcaggtatccccctgtatctggaagaaaattaagtcaaagtattctacacagtagaagggagacaactgtttatgtccatggttagacaattcaaggacaacttggatatttctaaagccatttccaaaaaatcaatggcaacaggttgggacacagctatttcaaagggtagaatgcctatacctacattggtttttattaacggggattgagttgcacctgtatagcatgatattcttgtctttagctttaaaggaaaagagaaagtcttttccatttgcaccagtttgaaatatttctgaaataaggctcccatagaatgg

SEQ ID NO: 389 - DNA, 458 bp, Homo sapiens
  Genbank Accession No. AA187437
  unsure (1)..(458): n = a or c or g or t
tttttatctttatgtttataaatttatttaatttccaagacttatgtgttcatctcaatccttgacatactcatctgccagacacaaaaaatagtggtctatttaagaggccttaatgaatgacaacatttttgaaatatgctatatgagtacaaatatttccagagcaaagagggaaaactgttgattgggtagacaatcaaattccaagcatttatctgatttacagaagtacatctactttttgtttttcactaaatgaatacaaccacttttaatatatatgtgggtgtggctgtgtgcgtatttcaaaacacacacgcacacacaataaaagaaacatttcatagtggcaaaattttagtgcactgccaaagtgctacaataactgtcatccacagacatccacatgcnaacactactggactagtacactagagccaataaggagngtattt

SEQ ID NO: 390 - DNA, 549 bp, Homo sapiens
  Genbank Accession No. AA187579
  unsure (1)..(549): n = a or c or g or t
ggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttaagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaacagcatgctcnatgtgttggagtcatgaagatgtg

SEQ ID NO: 391 - DNA, 428 bp, Homo sapiens
  Genbank Accession No. AA187938
  unsure (1)..(428): n = a or c or g or t
aatgggttaaaagatacggtgaggagtgtgttgagagaggtggagaaaaggagcttccagtcaatgcattcaccatatctgaaaatacttcagttatacaaagggaacacttcgagagtaaggatatattataaataagtctctcagcaagatgaacggatgaacagttcaattgcacccacaggagagaggtcttcttggagaatgcttgtttatagaatcttctgtaaaatagagttggctacttctaatgattcatcttgtactaaaacaatatcataagagtccatgtacttttctaaaagctcatccactctatcatttagatatccaattttcagaatgtgctcaacattggccactccatctgccattcttaagtctccttgggagtctccccagaagaattatgttacnattggccttta

SEQ ID NO: 392 - DNA, 282 bp, Homo sapiens
  Genbank Accession No. AA188378
  unsure (1)..(282): n = a or c or g or t
ttttttttttttcaagagtataatattttttattcactgataaactaaaagccaatttcttggtatttctcatgtatacttcatttattttattaataagcaaagccctgtaaggggagcctttgcctagtcctccgactcngattcatcttcatcttgactaatctggaagtaacgaagttcgtaggtctccttgtcagatgcaaccactcgaagccaatcacgaagattgttcttcttaaggtatttcttggtaaggtatttcaaataccttttagagaa

SEQ ID NO: 393 - DNA, 385 bp, Homo sapiens
  Genbank Accession No. AA188921
  unsure (1)..(385): n = a or c or g or t
gggacagggttttaaccacaaataggagcagcatgaattcctagtgacttgctgcacagtattgtatcataattacaggaagtttttatttttaaaactggatctggggtatattcatttgccccatcacctctgtctaaaggcccaagtcctagggctgccatggtcacaagcacacctgatgctccttaagattgtttatctggagcccacatagtgtggaacaaaaagtcaccctagaaagcatccttggtcatcattgtctccttcccaccctggcccagagatgcttaaatccaagttgtttctcnagctgtcacctcccccaggagatcaggattccactgacgtcctgggcagccagtgaatttaattttccatgaga

SEQ ID NO: 394 - DNA, 417 bp, Homo sapiens
  Genbank Accession No. AA189015
ccagtgtactatttatttcctcaagtgcttccatgggggaaaaaataaaagtctaatatgccagagaaatcatcattgaaccaataagacacagtaacataattctagtaacctacttctcaatgaacacacatctgagaaaaaaaccgccagtattttattctcatggaaaaacagaacaaacccacaagttggagtcacggagataaaatacagatgaaatggaaaacggtctgttgtcatgaactctcactttcaaataccattttatatggaagttactttactgcggggcaaacagaaggccatgctggagtctcttacttttggaaaatggagaatcaaaaatttgctaatcaacaaacaaaaaaggagggaaactcctttggtaaagctctacaaacataattatacatt

SEQ ID NO: 395 - DNA, 478 bp, Homo sapiens
  Genbank Accession No. AA190816
  unsure (1)..(478): n = a or c or g or t
ttactttcacatattttatttcattttaatctcaaaacagccttgtcctgattccccctatgattctgcaatgatttggctcattgttcagaaatctagatcccagtgccccgagtcaagtggggctggcttgaacaaaaggtactctggaaccccaggggagggccggtagaaaagaagggcagccagcatgtatagagttgtggagtggaggagattgcccagttctccaaggtccagctgactaaagcacctgcccctagtccacttggcctatgccaggaagtcagcaagctttcttggagaaggcagaaaataaggccattncaaaaggaaacnacccatggctaatggttcccaggtaaaaactcntatgggatacctggaaantttggaattttcanggttaatttttccccccttggaaanaaaaaccccntcccttttgggaattttttttcanccccttttacaaaan

SEQ ID NO: 396 - DNA, 358 bp, Homo sapiens
  Genbank Accession No. AA191014
tttttttgcttgctctgattcaggcactttcaagatcattgtttatttattacttcagataaaaagatagtatacatattagggaatcccttaaaattcaactctagagttatacaccatctagtacttttgcaatgaatgttaacaacaacaaaaaaaatctctaaacacctgaaagccccactattaacatggactatggtaataaaaaattttgacatttaatttgttcaacatatagtatttacattatgaaaccaatggtgatgatacaataaagtgataaagaaatagtaaaaataaactttaaaaagcaaaggtttatagtctgacaatgctaattatcctaattgtatat

SEQ ID NO: 397 - DNA, 391 bp, Homo sapiens
  Genbank Accession No. AA191310
  unsure (1)..(391): n = a or c or g or t
aattcaggaaaatgtggctttcattacggtcaaatctcaacatgtctcccgaagagtttataaaataagttattctaaacatgtacatttagctttggaatgatggagagacacagagatatatgtaaacgtcaagagaatcactccactccacgtctgggtccacacccttccaggctttgtctggaacattatgtggctggtgcctgattccacagtgaggatgcaggagcccaggtggtgatggataaagcattaggagacaatcaagtgtcaggaattggtcaataagaacggcttaaataatgatttaacaaggaagaccgagtaaaaaacaatcccatttcatctttagaaagaattaangtcactaaatggatttcttctaaag

SEQ ID NO: 398 - DNA, 521 bp, Homo sapiens
  Genbank Accession No. AA191488
tgagatggagtttcactcttgtcacccaggctggagtgcaatggcgccatcttggctcactgcaacctccgcctcctaggttcaagtgattctcctgcctcagccttctgagtagctgggattacaggcgcccaccaccatgcccggctaatttttgtatttttagtagagacggggtttccccatgttggccagactggtctcgaactcctgtcctcaggtgatccagcctgccttggcccccaaagtgctgggattacaggcatgggccactgtgtccggccctggaccttattttctaatgttaagtttgagttctgggtttagttgggcaagaatttccctcagctgccatcaatcctggctgaagttaacccctttccatcactgacccaggggaaaaaaccaccaaatttacttactatctgttaaaaattcaaaaaggaagcagatgatcaagtcattgaacaaaaagctacatggattagacaagaacatataacttggctctaagatgatgg

SEQ ID NO: 399 - DNA, 579 bp, Homo sapiens
  Genbank Accession No. AA191647
  unsure (1)..(579): n = a or c or g or t
atgcttccagtcttcttttaatgtttatagtcattccaaagtaacattctattttacactttcacatacattgttatgaatcattggtttttctcttttttccacttatcaccaatttatttcattcagccagatttggtgtctatagaaaaagaaattttaagaccattattaaaaataatatatggttagaaattagtagatggttctttaaatgtattccaatttttaatgttactttactcctgattcatttatatttttctgctttttatatgtttaaaaatctctcattctattgctgctttatttaaagaaagattactttcttccctacaagatcttattaattgtaaagggaaaatgaataacttacaatggagacacctggcagacaccatcttaaccaagctgaagttaacataaccagtaatagaactgatccatatctgtgcctcctgatatggtgtactaagaaaaacacacatcaggcctgaagtctgcaaaggtgctaaccaaatctaatctaggaacttggncaactcnatggaggacttctacaagtgccggattanggat

SEQ ID NO: 400 - DNA, 629 bp, Homo sapiens
  Genbank Accession No. AA191708
  unsure (1)..(629): n = a or c or g or t
ttctttaaaatacatacgaagtgtaaagagaaaatggccaaaacctcaaaactaccattgttgaaaacaatattaaaaggacacaatctaaaatcatgctacaaaaatagtgttatcttgtttaactaaatgtacatctttttttccaattccatgattgacaagagtgcttatgcgacgcatggaaggcaccagaggtgaagtgattatttgccttaaaatatacaaagaattgcctactttgaaaaaaaaatagtcatacttgtaaataaatagtttagtgtttctgccatgggttcctgaacccctacaaatttcaacatatacaaatagtttcaattcctaccattctcttagagggaaccacgtcaaacaaaatcaagttaggaaaagcactgattttatccaagtaggtcaatttgaggcaagattcaaaaactcttttaaaatgggttacgagtgaaagagttgggaacaggcagcccccttgggcctgggtcagcctacgagtccatcccggtgtcctgccctcacatctgccagccctcaggccggccaggtctccttcnaaccctgagtattgccttcctcacttctgcgaagaggggacagaatctgaagctgcnaat

SEQ ID NO: 401 - DNA, 518 bp, Homo sapiens
  Genbank Accession No. AA192755
  unsure (1)..(518): n = a or c or g or t
ttaagttttgtcaaaagtttaataaattcgcaacattcgacagttcnccctccctcgcccccgccccccgccccagtccctggctcctcctagtagatacgcgtttttttccagctcttgcaagcggggcctgaaaggtttcgggtccgggctgctctgggcanaggtatccgaggccccaggctggggaagggggcgagaaccagtcccttcccggaagccccgtcgcgctcaggcgggccttcctacccctcctctcccagcagtcccgttgctttcgcccccctccccaaactccactgggcccgcccagaatggggtgtgggtgtctcccgcttgcaggcgcccgcacacctaaatttcctctagaaagtcggtgggaaacagccccaccttgcggccggtgtagaccttgacgtagccgcccgcttcgtctcctttctgcaccacgatctggtccttcttgagagtgatctgccctatctcgcggttccncacgaaggatctcgtcacgcggt

SEQ ID NO: 402 - DNA, 383 bp, Homo sapiens
  Genbank Accession No. AA193204
tgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaagcatgacaacgggaggcccgcggggtgtttcaggcgcgttgaccaggtgcatggctggcaggcggcctctacagaaggagggaagcgcaattcacagcctcttgacgtaattttccggggaaagtaccaaagaatttggttcttcttgaggtccccacaaaccagccgtcatcacacttttc

SEQ ID NO: 403 - DNA, 250 bp, Homo sapiens
  Genbank Accession No. AA193223
taaccaggagaaataactttatttggactgagagctggagaacaagaataggacctgagatagcatactgggctaaggaggagaggtaaggttccaaaatggcagtcaaagctcatcgaccaaacagactctacttcccagcaaccttgcagttagtgcaaccaacaaaaggcctgctggggaatgtattttccactaaattccccaagtatgccaacattacaaaaaaagatagaggtttttcatcata

SEQ ID NO: 404 - DNA, 523 bp, Homo sapiens
  Genbank Accession No. AA193297
  unsure (1)..(523): n = a or c or g or t
caaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggacagagccgtggtcattgttgctgttacaaagaagaaaaccatctgagttctaactccttggttgcttaaaagtagttcccaagaagtctgagaagctatttccaattttttaagagtcatttttttgtaatttttggtaaaaccaaaagtaccaatcctgttttgtaaatnaaaaatcatcctaaaaattccg

SEQ ID NO: 405 - DNA, 302 bp, Homo sapiens
  Genbank Accession No. AA193671
ttttttttagacttgtaaaacaattttaatgtttactcaaaataaatgagatgtcatcattagcccttatctctcacacttgaaaaatggagacagttgttcagaatagaaagggaaacagctattagagtttaagctcaagtttcaagaagaattcagataaggcaggtaaaaactctagatacttttccactgtccaacatcaccaaatattaatttccacatacctctttatttcataaaaatataaatatttattagaaatagtatgtttaagattagtttttctttctaaataacat

SEQ ID NO: 406 - DNA, 75 bp, Homo sapiens
  Genbank Accession No. AA194075
tcagaagccacttatacagagcctccttctcacaattctcatcacacacacactctgcaaagcttgtgcagggct

SEQ ID NO: 407 - DNA, 619 bp, Homo sapiens
  Genbank Accession No. AA194146
  unsure (1)..(619): n = a or c or g or t
accaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttntttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgntaaagggggaattgcacattaatattnaactgggattgctccctccctcagttccttaaaaaccagagtcaaggctcccaccaacttgtaggctgtgggagctttgccataggtagatccatggngaagtaacctttttaagcatgaagaagccagggacctccttatat

SEQ ID NO: 408 - DNA, 139 bp, Homo sapiens
  Genbank Accession No. AA194237
tttgaattatgacagaaatctttattaaaatgtgtctttcagtaatatgtttagcattcaatatacacacatacatatgtacactctttgacacacctcatggattgctgccatcagtttaactaataaattaaaacta

SEQ ID NO: 409 - DNA, 520 bp, Homo sapiens
  Genbank Accession No. AA194724
  unsure (1)..(520): n = a or c or g or t
ccatnattnnnnacctttaatactctncngtntncacacncccacagtntnantgggctccnccctcacttantgnccgccgtnatggccttgannttgcctgcccgcgccagnatgtttggcacaaagagcagccccgaagcccgctcaatgctctcgatgggcaccaggaagcgctccagtgggatggcctcatccacaggtgcgttgggcatcacgtaggtgcggantcaatttgcccacctgctgcctccaggatcagcaccttgaagaagtgtgtgggcactgcacgtggttcttgccgatgacctggtactttacgtaggatttcccatcagcctctggtcctgtggggcagacccaggcacacgtgggcagggggcctgggatgaacccaaagccacctcttccaggcagccttccccgatctgtcccccaanttctggtcaacctggcangaccangccctcactgggaaaacttctngaagcntgcctggntcctccctgaaggctggaaa

SEQ ID NO: 410 - DNA, 157 bp, Homo sapiens
  Genbank Accession No. AA194730
tcaattcaggtgactgtttgatattttcataacattttctttaacatttaatagaaactatatacaataaatttttactatattttacataagatagcaaccacagaaatttacataggttaaaagcaagacggataaggaggacccagtcctgttt

SEQ ID NO: 411 - DNA, 292 bp, Homo sapiens
  Genbank Accession No. AA194833
  unsure (1)..(292): n = a or c or g or t
ggatttaccaacacgtaggcttttatttcttcccattacatctgtttagccacagaaagcattgggccatactcactgcagaagataagacttcctcagaatcttattcgtttagtgcactcaattttacttcactgtctcatcacttgagagactggttaaggcaagaaacccatttcttaacattttttttattttcaaacatttgaaaagcaacaccaaaacgtatgcagttaattcctcaattctttcccttagnatagcactttttaaattacaaaaccacacttac

SEQ ID NO: 412 - DNA, 362 bp, Homo sapiens
  Genbank Accession No. AA194997
  unsure (1)..(362): n = a or c or g or t
gtctctcagagaattatttaatantagaattaccatanttntggcgcaaatgtgnccaacaccaatgtgacaagtacatatatcngaatcantctttcctcagagaatcacaccttcccttggctctgctgtggatccaaatcaagcctgggtgtgtcngacaataccagggcacggtttgcttcncggccctccatctctactgtttggctacagcttgagttcactaggcatcggctcccctctcaggccagccagcaagttgttagctgccaacaaggacatggtgttgcgggttctgtgggtggcactgcaatgtngggcagaatcacacagttcttcagggtcaggagagggtggtt

SEQ ID NO: 413 - DNA, 556 bp, Homo sapiens
  Genbank Accession No. AA194998
aactttaagagattttttttaatgaaggaacaaatcaaaatggctcagaaaaatcagatggagtggatacacaaataaaatacatgttaatgcttaacacattgaatacaaattttctttatactaaagactttaaaatgtccatgtgttaatttcttttggaggtggaaaaatagtttgtccaaaaagacacttttcacagttgaaggaacttgaaagttctgtcccagtgagtcctaatggttttatttcaggcagcagattcattgtcaaatatcttactttttaaggtctgtaggttatgctgaataaaattctctgcaccatgaacttcagagaatctgaagtcacttctcctgacagaccagtttttcatttttattgaattctgaattgtgtccgatgtaaagtagtaaactatagggtcaaaacaacagttggaaacagcaatacagagagtgattgggtacattgtccttactgctgccactactgagcaattaacaaatgtttgtgttctcacaagagaatataaaataagattgatacctcgtgc

SEQ ID NO: 414 - DNA, 108 bp, Homo sapiens
  Genbank Accession No. AA195067
tttttttttttttactttttaagcttttttattcttgaaaagttcaaagatatacaaagatagactatgcaggataatgagcccccacatactccgcatctcttgtct

SEQ ID NO: 415 - DNA, 411 bp, Homo sapiens
  Genbank Accession No. AA195179
  unsure (1)..(402): n = a or c or g or t
tccaaggaaatcagtgtcttttacgttgttatgatgaatcccacatggggccggtgatggtatgctgcagttcagccgttgaacacataggaatgtctgtggggtgactctactgtgctttatcttttaacattaagtgcctttggttcagaggggcagtcataagctctgtttccccctctccccaaagccttcagcganacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggaaaaaaaaaaaaaaaaaaa

SEQ ID NO: 416 - DNA, 790 bp, Homo sapiens
  Genbank Accession No. AA195463
  unsure (1)..(790): n = a or c or g or t
ttttttccagtaacaattttatttatccccctaatttttatcatgggaaaaatccagaaatcaaatgtcattatgttatataaggtttaacttactttaaacaaaaatgtaacatagtgttaaaactggctttccaaaacagtcacagcatagctgtactctgtactaataatcacaaaattgtaatatagaactctgttatgcagtcccattatgttcttacaaaaatagaattaaactgtgtgaccagacaaggacttcaattacactacttggcaaacttagaatttcagtggagtcttttcctcttgcagtttaaagcaaaagtncaaatatcacatcttttcaagactcacaaagatgattcaggttgtttgtttgggctgtttttaatctcatcacaacggagggatgttttcgctttagtcctccgggcttcttcccagattgttactaagttntaaacaagaaatgctaactgcggggtctttcggcatcccttnccgaagggggctgtggtagtgtcccacaacattggnttcaaagcacacngggttcggcggcagtttcacangaactacacctggatttaggaggccaacactagcaaatttcaggccgaatggtagtaggcgtggaattcccgtgattatggaaaaaacgtcctttaatgggtttaggccancccccaggtatggaagttnggatttttcccattttatgtggaggcagtnggaaatggattccggctttccagaaagtttgnccaaacatggtaattcctggaact

SEQ ID NO: 417 - DNA, 395 bp, Homo sapiens
  Genbank Accession No. AA195515
  unsure (1)..(395): n = a or c or g or t
nnctttatcatactatttttaatgcatgaaataaaaatggtttatatgtacatagaatacacacacacacacacccctaggtcaatttcttaggtctcagttgtggttaaattcacttttaaatacaaggttccaagtatccaagttgccaggccagttgcctgtacctggaacagcctttccaccgaataagaagagtccctacttaaacagcttaagctaatttccatcanacnatttatcncagtctaattaccagtttatcagtctcccattaaagtgggggctccctgagagcaaggactggtcatcttcactttgccttgaaaagtagacatnggtcccaaattatctgctaaatgagtantgaacaatatngtctattcagaaggtgt

SEQ ID NO: 418 - DNA, 381 bp, Homo sapiens
  Genbank Accession No. AA195656
  unsure (1)..(381): n = a or c or g or t
gtagttttagtgaaaacaaatttaatatcatcttgtttgaacaaagctttcagaataagtgagcaattaaattcttaaagtagggacagaacaccaacaggctctagactccggaagagctgtaanccgacaaatgggcattgttttgcttaacagttttagcttcaatgtaaatatatattattacttagaatattagcatctgaactatataatgactattttatcattttacttgaattaaaaccagaatttctggaacttccaaatagtctttaaagtttttcaatataaacataaactaacccctattcctctctacatatcaaatgtgaaataactgtcacaatatatcagcattttcacagaaagatgtttaag

SEQ ID NO: 419 - DNA, 391 bp, Homo sapiens
  Genbank Accession No. AA195657
acaagtatctacaaaatctttataaattcacatatttttctgaaagtgtacaagcagtctcaatttactgggacaaaaatgaacatttttgttctttagtaatgaagtcaatgtacaattcagagcaggtgtccatagaaacaactaggtttgaaaaaacttaagacaattcacagttgaaatcaaacaaacactgtgaatgtgttaaatacttgccatataacaacgctttaacattgatcttgctaaataaggctatgattcataagatgcatgtatttccaaagctgtttaacattcttataaattaattcacaggattcaaatagttgctttttagcttcaactgggtattagcaaaaataatacaaaatgatccccgtgcaagcac

SEQ ID NO: 420 - DNA, 485 bp, Homo sapiens
  Genbank Accession No. AA196287
  unsure (1)..(476): n = a or c or g or t
atcatacttaattcatgaataacccccatagtgtaggttagttagcactatcaaagtgactggtaaggacgcaggaaaataaaaagaggattcaattgggttggtactgcaaaaagaatccattctgttcagcacatgaatttctgttctgaccttaagtttagatatatcaaagaaacaaaaagcatagaggcggctgggggtggtggctcacacctgtaatcccagcactttgggaggccaaggcaggcagatcacctgaggtcgggagttcgagaccagcctgaccaacatggagaaaccctgtctctactaaaaatacaaaattagccaggcatggtggcgtatgctggaaatcccagctactcaggagggctnaggcaggagaattgcttgaacccgggangcagaggttgcagtgagccaagattcacgccattgcactctagcctgggcaacaagagtggaactccatctcaaaaaaa

SEQ ID NO: 421 - DNA, 449 bp, Homo sapiens
  Genbank Accession No. AA196790
tttatgatttgtttcagttttattttcctgtctcagtttcagtaaaagattcagagaactgattgacacacatcataagctatcacccatataccctaaatatacactgtttatgctttttctttttcacggaacaaggtgacactatctttgttcaaaccaaagtgaaaaggaagagatacaataattttaaaaagaggggtgtgtgtggtctttcactctcagatagtgaatgtacgtcaccacaacaaggaaaaagcgctgaggaagaatgtgcatcccacaggtcagagagtcaagcaggaagtaccagtagagcacctccaaatatagcaaatttggaacaactaggcattactgtgaaagaacttcctagtttttcatttgtctgccaccacattgctacattggaatttaagccctcttcacagtgccaatatcaaaatgag

SEQ ID NO: 422 - DNA, 433 bp, Homo sapiens
  Genbank Accession No. AA197311
  unsure (1)..(433): n = a or c or g or t
gacagcagtgcccaagctggcatccgtcagnacntgtgggcctttgtgttttgatgctacacatgtctatggagggccacttcttctgtaagtctgtggggcctcagcatacccaataggcagcaagtttcagtatttcccagttgtatgtcctcatggtggggctatgtctcccccaccacttcccctctcatcaggctagactttaacatccatcaatcatgtcttgagtcttgctccttcctcttggcttagtcatgtgactacagatcagatgcgtggccntagtgttttaggtgtgcaggtaccatggccccaaatgctgttgtatctgactgaggaaaatgccnctgtcctcnggcgtcccnagggnccgtaggtgnnagctgaatnggcatatgtcttccactctgttcagtgtnnaacactgcca

SEQ ID NO: 423 - DNA, 428 bp, Homo sapiens
  Genbank Accession No. AA199603
  unsure (1)..(428): n = a or c or g or t
taaaattaatcgtgaacacttttcttggtaaaaactcaaatacagaggataggcaggatgtctccctgcccccagttttacttcccgacccaaaggaaacctggtaactggctgtcatcctcccagaagtttttctatgcctttatttattaatgtacacttgtaaaacagcatttgggtttgctgttatactaatggcgttataacatacatacattgcagctcttttttcatttaactgagcctcagaaatcctttccatatatacatgtagatctaggccattctttttaaagctgagtaatgtttcatagtgtgggcataatacctacacttgtgtatttccagtaagcctttacagatactactaccntttttcctttaaaaattaaaaggtataatattaataaaaattccccgggaatttg

SEQ ID NO: 424 - DNA, 905 bp, Homo sapiens
  Genbank Accession No. AA203222
  unsure (1)..(905): n = a or c or g or t
atacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactttttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaacatgtccctttttatactcattcccccaggcatggggtagtgctagtcgactgacagggacacgggttcagtggcttggccctatctggaacgctgcctgtacgatngtatgggtgctcaatccgtgttcctagcgtctacgaggctaaacggggatggagttaccacntctagcgcggatgcatcncatgaaaggaagcaccttgtggaccggcacggtactggatcacaagaggtgttattgtaatagagcttatgaaacgccccttgtataaaagattgcggccttgtttgcggtggtggaggattcactgtggcccttgcgaggcgtcccttttta

SEQ ID NO: 425 - DNA, 559 bp, Homo sapiens
  Genbank Accession No. AA204927
  unsure (1)..(559): n = a or c or g or t
tacaatgtgcattttattccatatcattatncaatgtttacatatagttaanactctcaaganaacgtcctttaccagttgtatgtggtgtctaaatctttaacatgaaggactgaaaagggtggaaatccacactgattgttatcctacagattgtcatgagctgcacgtgtncaatcaganaggaatggaagtctcagaagagcagcgtggcttacagacccttggctttagtgaattcaggcatgcgggatccatagtctcatcttgtaggtaaaactcaagacaaanataanttanntgttggacagagttcntacattggtacaatgnttnaacaaaaagacccacaggggganccttttngttcaaagtnggcnccaattccacacctgattgtggtntccaacattnaaccttcctgtttgnctccancattgggcccttttgaaagggaacttctcctgcnttagntgagggattcccangntnantaagcccactggtngtttgctaaanncncctacaangtnttggcggcatnaacccgggaaantgg

SEQ ID NO: 426 - DNA, 523 bp, Homo sapiens
  Genbank Accession No. AA205724
  unsure (1)..(523): n = a or c or g or t
cccattgggtgacagcgtttattgaaaggaaatcttgctttatccaggaattcactcacatggaggtagctgcaaggagaatgtctctttctcatgacaaccaaagcgaccaaaccataccctaaagcagagacgcaatggaataagtcaacgggcattgtagaacgacactcagaagcaggaaaaaccataaaagatacaggatgattgtctcttcagtattgcatttggccatgtatgtgtttttacataaaatatatgttttctttttaagctagctaaagaaaatactcttgatcggggttagttcttaaagcaaaaaacagaagaaaagtatgtatatataatanaattaaagaacgatagcatgttatacctggaaaggaccgtgggcactaatctgcactttgttccaggtaatccatggctctgagagtgagcacactgtcaaagtcactggggtgagatgagccgggacttggaaaaccctctcttaactttcagtctcaactcctcccactcc

SEQ ID NO: 427 - DNA, 335 bp, Homo sapiens
  Genbank Accession No. AA206023
  unsure (1)..(335): n = a or c or g or t
aacaacagctaacatttcttgagagcttactgtgtgccagacagtgcggcaggcactaattacaacctcattttgcggagacaaaaagggaaggtgccctgagaggggcgtgccaagtgccacagttggaagtggcggaanagggacatacccccacgcagtctatgtgggggaaaccaggtgcactgtcctctctccacaatcttccctgacccagcatgcaaagtgtgcnaatgcactgtaagggatggggcccctggntgacaagagtgtggagnaagggcctggggggaccatggcctgatgggggggccactgggaccagggaccttttg

SEQ ID NO: 428 - DNA, 409 bp, Homo sapiens
  Genbank Accession No. AA206914
  unsure (1)..(409): n = a or c or g or t
tccaagccgcctggtcctgggtgctttgtcttggcagccatagcagatgaatgcactggcgtttggtgaaaaactggcaggctttgagggagtgagtcaagtgcatgggaagggaaggccctctgcatangntccagggtggtggcctgagnaagcgtgtgcccaccacacagcaccgtgagagaagccggccagctggagcagtgcacggcacgtgagtgangtgggagatgaggtcagagagatggggggcaccttggctttgaccctgagtgagaagggctcaccggaagagttgcaagcagatggggggatggacttctggcctttatgttctttaganggtccctccggagcctgtgntttacctcattaaaggggcccaagggtaaaaagttnaaaaggccna

SEQ ID NO: 429 - DNA, 416 bp, Homo sapiens
  Genbank Accession No. AA207103
acgatagttacttttgttatgtattttaccacaatttttaaaaagcaaaccaaaaccaaccaagagtgcttcccccacacctcaaaatcatcctgcagcagctccctggcccagctctctctcaccctgaccctgggcccctctcccaccacccagggctagccctgtggaccaaccatctctgccagcccctccccgaccctccagccagggaggtggggcgctggccggtgaatggggcaggccaggcccaaaggctggccaagggctcaccagctctggactgggcgtcccgtctgaggtggggatgaccaacatgccagctctgggttttagcttgaggatgggcacattcaagcactgacagccagcaagcttgggcacagggcgatgcttaacctttaaaaaatcgggta

SEQ ID NO: 430 - DNA, 413 bp, Homo sapiens
  Genbank Accession No. AA207123
  unsure (1)..(413): n = a or c or g or t
agaaagtaaaaaacgtttgggtatattttgatccatgggtggcattttcaaatgtgcaaaaacaaagtcttggaagagattccttgtcactagaaagttcgcccttccttttgctgtcagttgtacgtaagagaaattcgtccacattaaggaatccaaaaagggtaaactaaagggatttaaaaagagtacattacaaagaataagaagccctgtaacatctatctgagaatactagataaatctgtgagtagatgtggcacctggagctactcactacattactaaaaacaganacaagaaatctataatggcaggatcacaacatttgcgccgcaaataggctaacccaaccaaagactggccaccgagaggccagtnctgtctctgtgactggactggggaacttggga

SEQ ID NO: 431 - DNA, 449 bp, Homo sapiens
  Genbank Accession No. AA210850
tttttttttttgctgatctagacttattaaatttatttcatgtcattgtggtcacttttacagctgtttagacttattttcaatcacattactcttcacagaattcacagaattcattaactaactagtatgttacatccaagggttcttagtagcacattgaaatagaaaagaggcccacgagttgttgcttgtgtgtggaacctgagtctgattacttagacagatgtctagaacattattgctttattaggcctatttttaaaaataataaattattcctaggaaacccaccctgccaggtgctcattctgcgactgctgtgggttcactcagaacatacctgactggtgggtgctgaatgaacctcccacccatgtaccctgctgctccggacgctctgagggctagagcaatgcccctccatggcgtgtaaacattttctacag

SEQ ID NO: 432 - DNA, 393 bp, Homo sapiens
  Genbank Accession No. AA211370
  unsure (1)..(393): n = a or c or g or t
tttttttttttcctgagtagatctcacctctttattttttctgcctttgtctgcctcctaccaccacttctcaaagcaaatgtgttctttgggtacatggttgttttccagttgcttggagaaaaagtctgtcattggaggtgggccacaaatatagaacaaagtctcttttgaaatatgatctcttatctccttctccgttattcttccttccgtgatgtatggcttgagttccgcattgatttgtgtagtctgttttgtaacatgcaaactgcatgcaatcttctcaggaaattcatttactaaatcaaggatatttttcttaaacaggagttccgctgggtattttttgcactgtagaatagttttaattgttccnatccccatatccat

SEQ ID NO: 433 - DNA, 408 bp, Homo sapiens
  Genbank Accession No. AA211388
ttttttttttttttttttttttccctgcaatatttattaaggaatttacacatacacaggagaaaggcagccaggaactgtggttccacacatgaaatcttttaagcaaagttttcttgtctgaattttcaagtggggtgaacaatgactgagaggaaagctgtcccggccctctgcctcgtacacctgggaacggtggggaaacagagcaccctggatacacaggcatgaaagagtgatcagcagaccgggagaagggaagggagaaagggagttatcaatgacatggcgttttttaaaccataagaaaaacacaacagttttaggctgctgataaattaattcctctctgttgtaaacctaaaactaaacaaaaacaaaaatacccagagcagatggggagagggt

SEQ ID NO: 434 - DNA, 458 bp, Homo sapiens
  Genbank Accession No. AA211418
  unsure (1)..(458): n = a or c or g or t
tgtcagaggattgaggcaaatcctacctcggggaggaggagctttcttagcgacaggaactggcactgcaactttctcctctgggacgggtttcttaggcagactggcactttagagacattatgcacttttagaaatttaatgtgatctcattgaancccagtgcaaaacaaagaaatacacccacagtgcactcatatcacaaaactaacaaaatcactggaacataaagacagttcttgggaagatggagaaacaataccttttggtggtggtggaacttcttcctccttccgaggaacaggtttcctttcttcaggaactttcttctttggtatttcctggcacttaaaaggatagtattgaaattttaaaatttggtcaaaaagggccanattaaatggaggcacatagaagtggccattaaagaagacatgccatttaaaganggcttgaag

SEQ ID NO: 435 - DNA, 491 bp, Homo sapiens
  Genbank Accession No. AA211483
  unsure (1)..(491): n = a or c or g or t
tttttttttttttttgaaacaggagtgctttatggtctgagtggagtgtttgggaggagtgcctcccggctcctgccttcgggctcacctgagcgggggcgcantgaggccactgtgggaaacacaacccccactcccaggagaggcctcacatgctgccttcggtctcgccagccttctagcgtggggcctgggcgccctttaggtgagtctgcacacccgtgttcagggctcccggccggaagcggaaccataggcatgctgcggccccagatgagcgcggagggcaagcaggtgccggggnagcgcacaccccacagccaagcggcccctgcccagcctctntaaacagaccctcacaggtccctcctgggcctcagtcacatccctnagaaanactggcggctctgcccgagangccagggtntccaccgagcctggctgaagcagctgtcccctcccttnttgcagagaggctcaaatgggcctga

SEQ ID NO: 436 - DNA, 177 bp, Homo sapiens
  Genbank Accession No. AA211851
  unsure (1)..(177): n = a or c or g or t
ttatttttaaaaaagactttattctctagacaagacaatgaaacccatcttccttgtatagagggcaaggaaagtttgcataaacgcagaatgtttcagcagctttgggttcactccatggctcattttcttcttagcaatcagncatggtgaacttggaggacccaaaagncatta

SEQ ID NO: 437 - DNA, 346 bp, Homo sapiens
  Genbank Accession No. AA213696
  unsure (1)..(346): n = a or c or g or t
ttttttttttcttttaggcactttttattttccaaaaaaaaattgtcgttaatatataaacatctcattctctcaaaaaattctacaactatacagctgtttgctccattatttgcataggaaatgaccacaatacaaaaataagagggaaaaagaagcaaaacagcaaccgatttctgcttttcatgtaggtgtgtttccacgtataaacattttgaagcctcttacaaaattatttacatcgtttgtcatcnatttacatcttttaagagcaacttttctaacaaacaaaactataatttatcaagttatgnaaattgtcttctaaaaaaacttactatattac

SEQ ID NO: 438 - DNA, 514 bp, Homo sapiens
  Genbank Accession No. AA214542
ttcaatcattattataatttttagaagttaagattatttggattccataaatattaatttggataagacaggttccacacatttcagacaaacaggtcttttacctatagagggagaatttcatctacgcacttttccatttttctgaatcatccagataatggctgatctctggggagaaaagactcttctttgctcctccttacttctttctaggtgaaagagggcttgatagagatggtgacctttaaggaaaaggactgaactctggtgtcacaaggggttgtttctccttgggaccagtctgttttgactctctctttagagcttctaaagggagtcatcatttggaagtctccctttttccttaaaactgatgtgacacaacaggtttgaagctgcctctctctgggaagttgatggtagcctaggagggcctgaagaggattgttcagatgacctttaggaagaatcaataataaatccatatctctctcccctctctctcctcacc

SEQ ID NO: 439 - DNA, 475 bp, Homo sapiens
  Genbank Accession No. AA215299
  unsure (1)..(466): n = a or c or g or t
annttcggcacctgggaaaaaggagagcatcttggacttgtcaagttacatcgacanngacgatccgggtaaagttccagggaggccgcgancagntggaatcctgaagggcttcgacccactcctcaaccttgtgctggacggcaccattgagtacatgcgagaccctgacgaccagtacaagctcacggaggacacccggcagctgggcctcgtggtgtgccggggcagtccggtggtgctaatctgcccgcaggacggcatggaggccatccccaaccccttcatccagcagcaggacgcctagcctggccggggngcggggggtgcagggcagncccgagcagctcggtttcccgcggacttggctgctgctcccaccgcagtaccgcctcctggaacggaagcattttcctttttgtaaaaggtttgaatttttgttttccttaataaaanttgcaaaccttcaaaaaaa

SEQ ID NO: 440 - DNA, 477 bp, Homo sapiens
  Genbank Accession No. AA215379
  unsure (1)..(477): n = a or c or g or t
actttttagtagagacagggtcttgaaatgctgcctaggctggtcttaaactcctggcctcaagagagcctcctgcctctttttttccttttaaaataagaactatcactgttttcttctccttccttttttttttttttttttctctagcaactattgccaccctggccccaaaagttatttatagagtacattggtagtaattatacttacaatttagtccatggagtgcaggaccatgaggaactatagctagataagattgtgccagaattagaagaatagacattttactttcagagaccatgactaaaagaatattaacaccaagatgctccttccatcagctggatgtacctttgggcttggaaagatggcaagtataggagttgtactggaacggctggatcaaataggttgaaggcatttttgtcattgtacatgtggggaaaagcaaccaagtaataagacnccacn

SEQ ID NO: 441 - DNA, 278 bp, Homo sapiens
  Genbank Accession No. AA215468
  unsure (1)..(278): n = a or c or g or t
ttttttgacagagccacactcgccgtctttattttgcactcaccctgggtgacactgggcaggccgctcctgccacagccagactgaggaagaacacagcactcggcaggcccagtggggtccgtgcagggaggacccaggaccagccttactcccgagcaagggacacagggccccacagagaacccctccgggaggttctctcctggctgggggagggctctggacccccacaaacactccccaactttcgggggctggggcataaaaaaaagnca

SEQ ID NO: 442 - DNA, 396 bp, Homo sapiens
  Genbank Accession No. AA215585
gagatggagtttcactcttatcacccaggctggacgacagtggtgcaatctcggctcactgcaacctctgcctcccaggttcaagcgattatctcgcctcagcctcccaagtagctgggattacaggcgcccacctaatttctgcatttttagtagagacggggtttcaccatgttggtcaggctggtctcaaactcctgacctcaggtgatccacctgcctcagcctcccaaagtgctgggattacaggtgtgagccaccgtgcccagtgagtagacagcaaaatttaaagttcaccaactgatgttcccaaaagtgctgaacactaaatgacacagggctatgaggtacatacatttcttttagtaggagggaaaagtaaaagcttttcaaagt

SEQ ID NO: 443 - DNA, 420 bp, Homo sapiens
  Genbank Accession No. AA215919
gaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttccttccacttagagcacgctttgatccagttggcccacttccaggagctataccccatctttgccacgggcgagggcgggccccaatgacagattttccctttagagcccagcaggggtgtggccaactcataggccggctgtcattcatgtgattgatttgtaatttcatatctggagctccacttgtttttgtttctaaactacagatgtcac

SEQ ID NO: 444 - DNA, 357 bp, Homo sapiens
  Genbank Accession No. AA218663
cttcctcttcccttcgtcttttcctttctctttcttccctttctctctcccgttctttttctctttcttctctttcttgcttctccttttttagacgctcatcacgatcaggttcttcggttcttttccttaacttttcttttaattcttctacagtagctttaattttggcatagccatgtgttgttttcccatcaaatggtcatctacccgggactgggcatctcctactattaaaaaggctccacatacttcacaaacttccatttgtttttcttgtgcagcaaagctttcaattgtcgacgttgtggaccttaagcagttctctctcttcttttaattggctcaactaatttc

SEQ ID NO: 445 - DNA, 411 bp, Homo sapiens
  Genbank Accession No. AA218727
tttttttttttgagatcgagttttgctctgttgcccagtgcagtggcatgatctcggctcactgcaacctccacctcccaggttcaagcgattctcctgcttcagcctcccaagtagctggaactacgggtgcgtgctaccacacccagctaattttttatgtagagacggggtttcaccgtgttagccaggatggtctcgatctcctgacctcgtgatccgcctgcctcggccttccaaagtgctgggattacaggcgtgacacccgtgcccggcctcaactttttatttattagcttgttggtcttcaacctctgtaagcctcagtttcctcacttatcaatcatctactgctgtatagagacaggtccatctcctagcatgcagggtgaggctaatgtgacatttgaa

SEQ ID NO: 446 - DNA, 377 bp, Homo sapiens
  Genbank Accession No. AA219039
atttaatagggaagggaaatagctaattacatatgttatcaaaggaagccaggaagtgcctggagagaagatacatccgtaaatctcagagtcacacatcatagcacagagtatggagcctgtgagaaagaactaactgtgtggctgatgtcaaggtttcatccaagctagaaaatcttgcatagaaagcacccaaacttgtacttgccttgttcccttctgggctcccgaattgttatagggcttttgaaaaaaattaatgatacaaatcctgcatcccaaataggatgactgtataatcacagaaccagcaggaactcttagcagttcccatgatgtggaccaaaagcaggaccaactccaggcaggcattctat

SEQ ID NO: 447 - DNA, 444 bp, Homo sapiens
  Genbank Accession No. AA219304
  unsure (1)..(444): n = a or c or g or t
gcttgggcaaaagtcttcagaacaaaggctgtgagcaggtgttgccctggttcctgccatatcgctccccaaaggtgctgtaggagccatcatagtgtttgtagttcaactgtctctggtaaccagtgttgagatagccaatggcttggacttgacctctggagtaagctgctgtgtttcatttagataatccagtacatagatgttaggagcaaagaggaccatattctgctctccacagccatagggcatctggagaagattttgtgtgttttgcatggcagagctacatatgtctcccaaaactgagacagaagctcgggcagattcttctaccacatttggtggcagtttcagggataattcttcagaaacctcancacctgntggacnaagtagggagttgaatgttgtttccttctctagtccttcaggttcaaccaa

SEQ ID NO: 448 - DNA, 312 bp, Homo sapiens
  Genbank Accession No. AA219653
accaaagaataaatgtactgtattaacatgaagactaatgacaaatgcactgcagtagtaagcacgtcatagatgcatagaatattctctatatagtctgaatatggatataaaataagttatactcattttgttttccatcacagtaggagcatagcatacaaagtgattggttcagtggccatgaagcaagccaggggagagaccacagaagagaatgtagggcattgagtacagtggggatttgccaaggacactgcagagtccctggggaccctctgggaacaaggccccaaacctctcaagttagcc

SEQ ID NO: 449 - DNA, 376 bp, Homo sapiens
  Genbank Accession No. AA223335
  unsure (1)..(376): n = a or c or g or t
gatctttctagaatttaataaacttagttattctaagttatccaactatttggattcccaggtttcatgattgcaaaaggcaggaatgggatgtgaatgggcagacagtaattcagttcttggtttcttttcctttgatttgtttacaanngannatttgcatgttttctccanggacgntcgcanctncttgctggccaagacatccaggtcacagcagattcggncncgtgtggnanaacccatggatgatgtcatccacaaaccctcgcactgctgcagggaaagggttggcaaacttctcgatgtactctgcctgagcagcttccacattctcatgccctttgaagatgatctccacagcgccctttgctcc

SEQ ID NO: 450 - DNA, 495 bp, Homo sapiens
  Genbank Accession No. AA223902
  unsure (1)..(495): n = a or c or g or t
gaatgtaaaaagttttataatttattttctccttagggcaggtgtacattacatattagtgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggccttcaatgatcctccattctcattcctgtagattaagagttcatattgtatatctgaccctgaaatgtacaaacttcacactacaacattcttcatgacactatttgttatgaggaaagttgcagctaaatattagtcatgtgacttaaattttgagaaaatggaaaatggtaataggtataaatttcccngacacatacagcaagacaaatccagcccagcctttggatgatcaccttaaaaagcccggagatggncataacctggttggggaaaatttgg

SEQ ID NO: 451 - DNA, 511 bp, Homo sapiens
  Genbank Accession No. AA224502
  unsure (1)..(511): n = a or c or g or t
nncntnggaaagatctgcctcttctccaagaaactcaaccactagtgacaatgaccagcctcctgactactccttctccaagagaagaactgatgaccaccccaattttacagcccactgaggccctgtccccagaagatggagccagcacagcacctcattgcagttgttatcaccgttgtcttcctcaccctgctctcggtcgtgatcttgatcttcttttacctgtacaagaacaaaaggcagctacgtcacctatgaacctacagaaggtgagcccagtgccatcgtccagatggaagagtgactttggccaagggaagccgagaaagaggaatatttcatctaatgacttccaggccccnaggagcttattcctggctccatcgctaacacgttgactgcttattatggggaaagttttctctgaagccagggagaagcattgattgatgtgggcaaatccaagctccagccaggtcgcagtccnaatgccgcatcactgacttca

SEQ ID NO: 452 - DNA, 309 bp, Homo sapiens
  Genbank Accession No. AA226925
ttttttttttttttttctttttttttttcatttagtctttttgttttattcaaatgtcaaaatgtaagttccaagatacaaattatgtttgatttaaaaacatcgactatgctttgttaacaacttccaaagccaaatgtaagttgttgtgactaaaatgcctccccagtacatttctggaggattaaccttaatatgtttagcagctagtctgatttccactctacaaaaaggaaaatgatgctataagggaaagataatgaacaaagttataatatgtaagacttcctgggaagaacttgaaccatt

SEQ ID NO: 453 - DNA, 267 bp, Homo sapiens
  Genbank Accession No. AA226932
tttcacagaacagggtggtttattatttcaatagcaaagagctgaaaaatgtcgggtcccataaaggagcagaacctgacccagagcctgcagtacatttccaccccacagggtcaggctgggccaggcagggcaaaggagcagaaatgggagtaagagactgtgcccactgagaagctctgctgggtgtgggcaggtgggcatgagatgatgatgatgtagtgtaaggaccaggtaggcaaaacctgttcaggtcttgttgagtgt

SEQ ID NO: 454 - DNA, 470 bp, Homo sapiens
  Genbank Accession No. AA227145
acatagcaaattctttattttcatattaacagtaaaacataaaacagaaacattaaaacagggcataaacagagttcccatggccctgttttcaaagcaggggcaagaatacatacaatgacaagacattttgagttcgtttaactccaaatcctcaagtggggaaaaaaacttagaggtagtgacaaaggaatatggtggggcagagactggtggagcccagaagactaaagcctggatttataaatgtgatgtcctacaacggggactgggaatggcatcagggtttttttttgtttgtttgtttgttttgagatggagtcttgctctgtcaccgaggctggagtgcagtggcgcgatctcgactcactgcaacctctgcctcccagggttcaagcaattctcctgcctcagcctcccaagtagctgggactacaggcatgcgcaccactgcacccagttaatttttg

SEQ ID NO: 455 - DNA, 375 bp, Homo sapiens
  Genbank Accession No. AA227452
tttttttctgaattcatttatttagaggtaaaacacagccattcaaaattgtggaatacaatgtctacacacagaataaggttggggaattaagctgaattgttatattccattcacattaataaatatttttaaagaagaaattgtagattttaaaagcttcattagacactagtgacacatacaaataactaaactctcatactgcttgattttcaggttgaaaggttacaataatctatatatttcaattacatggcagtaaatacaaaagcattttaaacatcttttgaactgtgtagtatactataagcaggagtttattctaaaacattccatcattcttctgacctgtttatgggtcatgctggacac

SEQ ID NO: 456 - DNA, 402 bp, Homo sapiens
  Genbank Accession No. AA227480
tttttttgattctattacttttattaaatagtgggtttccacacatggctttttaaataatccaggcaggagaagagaggagggcacacttggaactcccctccccacaatacgtgattatttacattttagtaattggacaatcccggctcaggaggaggttgcaagaatctgcaaaagttggagggagcgccccaggagaacaaacagcaagccttatttcccctagcccatcccccaaaaaaccatccatcccatcctagtgtctggtggtgtccggtggtgtccatcttccattccttcccaaattatggaagtaaggttcttctcaccagaataagagcacttgggataacagagtagggtcccctcacccaaaaaaaaaaaaaaaaaagaagaagc

SEQ ID NO: 457 - DNA, 417 bp, Homo sapiens
  Genbank Accession No. AA227541
cacattacaattttaacaggtttatttgagcattcagcaattttatcaatcaggcagtggcagaccgccagcagttcagggcgccaccaccgaggaaaccagaggggacacttacaaggtgtctctgggagcaagacaaagaaactatttgattggttagagtggaaagttcatatttagaggttaactgaccataaatctcttgttagaggttagtcggtagtttctgactggttaagctgaagtttcctgctcctaggttacacacaacactttcactctgagttgagtttcagtttgctgacttaggaacccaaagtgcaggagccatttcagcctattggcctcccagcgaattttttataacaggtgagggagggtgcttagtgtgtatcagaatagcataccaaaggaagc

SEQ ID NO: 458 - DNA, 343 bp, Homo sapiens
  Genbank Accession No. AA227560
agcattccatcatgtttattgactcctgggggacaggtcacaaagtcagtttgtgggcaggccagactgccatagaaggaagtcaggggcctcaaggggtggcactcttccttaactcgtaactcttggaggcaagcttggaaggtgctttatttcccgctatgattataccaaccctgtggcctgctccaggcttcaggatctttagggccttcttgcgaacctactggtggggggtgctgcaagccctccccttgcccgaagtgccaagccccatgtgggcaaggcagttgtctgttgcatagtcaagtagttgttgtctccaacttgcaccccagagcag

SEQ ID NO: 459 - DNA, 390 bp, Homo sapiens
  Genbank Accession No. AA227901
tttttgtcaagcgaaatagttttaattagtaggctgatcataaataaatctacataaaagatttaacagaattacaaagagttttgtgttcctttgtggactcaattcataatatgcattagtcaacctcattctctaactgtgacaaaaagagttgtcatccaacaatgcagcacagtttaagcaattcatatgctatagttacatttttacattttctttacaaatgtaacatttatgtacattatatatagatttttttctatagttcatgtactgaaactctattgtttttacagagaaaatgttgaattcatttaatgaataagaaacattccttgttaaaaagtaattcatataaacaaataacacggtaccaatgccttttgg

SEQ ID NO: 460 - DNA, 323 bp, Homo sapiens
  Genbank Accession No. AA227926
atgtaaactatcaaatgtttatttaaatttccatttaaaatattttcaagtaaaatatgtacaaaaatggttataaaatggttgaagcaactagaagcgtgacaggtataatacatataaatacaaccaaaattcaattcaatgcaaagttgaatgacatcatattgcaccaaaatttattccatacaaaagcacatgcatcaagagtttccataagatgaaaacaaacacacttacttcatagcatcttaccacttacttacacaaatagcccataaacaccatctggcattgtgattgcagtaccagaactctccccagag

SEQ ID NO: 461 - DNA, 333 bp, Homo sapiens
  Genbank Accession No. AA227968
tttttttttaacagcttgtactttattacatatgcaaccttgccatgcctgccagttaactcccctcccgccaatgttatcctcatgatatcagctccctcttggggccactgagctgcccccctttccttctgggctggagtagtggtgcccctcaagcaggcaatgggcagggggagatccacaattaatcgtcgcagttctcttaaaagtattaacacttaaataagcactcttggggagttgcaaaggatattcaggatgggatgcagtgggaggctacccctcatccaaggtacaggctggaatgagctacagctggtctatcgtggg

SEQ ID NO: 462 - DNA, 359 bp, Homo sapiens
  Genbank Accession No. AA228119
aatttttaaaatttcacatttaatgtcatgttaaaaacttttctaaatcagtcttccagtatcggattcttaagtgagaaaaaagaagacaaaagaggaaaattccgtatcaattatttagcctcctcccttccctagaaaccaacatttccttttaaatgcaaggcacactccttttcttagaacagagatcaggaaactttttgtgtaattttgtgtaaagggcaggttaataaacattttgggctttgcgattctcatttggcttctattgcagctgtttaccttaggctggagtagtgggaaagcagccatagacaatctgcatttataaaaagaagtccaaatttggcctttgg

SEQ ID NO: 463 - DNA, 394 bp, Homo sapiens
  Genbank Accession No. AA232114
ttagcatagtcatcttagctttattgagtaaggcatcccaatctctgctaagattcttctaaatgaacggctgatttttctgccaaactatgcattggtcaaagagaaatcaccacctggccaccccattctgtccccctacaggacactaagggttcttacagataaagggacgatgcattcatgcctggagaactaatcacacctgatttctctgggatctaaaataatgtcaaatttgattcactttatgtaaagaaaatcttttttttctgcaaaccccttcagaacaatgctgccatccatgcaagatgtgtgtaaggccacctctgtatactaagaatggtgccccagcaggtggaaggatggcacacctgctgagcgtgggcacacg

SEQ ID NO: 464 - DNA, 401 bp, Homo sapiens
  Genbank Accession No. AA232508
gagggtacatcgggggagaggagaggagaggagagcctctctgtgccttggtttcccatttgtgcattcagggcctctgcaggctcacacagggagtctgaggggatagtgtttaagtgagcactcaggcttcctctgaggaaaagaaatgaccaaagtgcagacttttattactgccattcctgctcctaatgggagcaggagtcaaaaggaaaaacaaattaaaaggggctaatgagaaaggaggagagatgagacagagagtgtgaagggctatgcgcgtggcatctcataaattcttattgagaatggcacaggtattaaaaaagtttctgggtagtctacgagaaatgtcaattattatctctactacaactacttacatatatctaatgggaaaa

SEQ ID NO: 465 - DNA, 425 bp, Homo sapiens
  Genbank Accession No. AA232837
acgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggagtgagaacaggaagccattcacctccgctccttgacgtgagtgtttccaggaccccctcgggccctgagccgggggtgagggtcacctgttgtcgggaggggagccactccttctcccccaactcccagccctgcctgtggcccgttgaaatgttggtggcacttaataaatattagtaaatccttaaaaaaaaaaaaaat

SEQ ID NO: 466 - DNA, 388 bp, Homo sapiens
  Genbank Accession No. AA233126
ttgataggattatgaatgatttttatttttttctttatactttgtttaaaattttctacaaaattgtatattttttaataattaaggaaagagaaatctttttttaaaaaaatacatttatttcaaccatattgtaacttctgtttaactccattgcctaattccaatggaaaaaatgtatctatctgtagccttctttggaatattttccagatcttctccccgtcatcatttctatagccactactgcaggaaggttttatcatcgtgtatcccctcttcggtgtgattatgtcaggagcagtcaatgctagagaaatttttgctcctctaatttaataataataactaacatacattaggtacaccaagtaccaggctccttgta

SEQ ID NO: 467 - DNA, 326 bp, Homo sapiens
  Genbank Accession No. AA233152
agacagaaatagaattttattttcttttaagcactgtattttttatttcttcattatagcacattaccctaatgtaatattcataagactggcatagatttgaaacttacctatctcccacctagaaatgggaagagcctaaagatatgggtcataagaaacaaaaaaagggctggattagggcactccttaggggaaggtagactcacatgggccactgaaataaaggaacctgggtggtcagctagggggcaggataaagttttttgacatctggagggggcaagaggatgaaccaatgaagatacttcatgtactttaaaatt

SEQ ID NO: 468 - DNA, 525 bp, Homo sapiens
  Genbank Accession No. AA233225
gagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggccacactcgagctctctttacattgttagttgtcaaccttggctgatggaaatcccgtaaccactatttgttgcactgtgccatgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaggcatttgaaataggattttac

SEQ ID NO: 469 - DNA, 188 bp, Homo sapiens
  Genbank Accession No. AA233290
atatgcattttacttccctttaatcaaaaaataaataagtacactccacagggactttttttttttaatgaggaaaaaaggtgaaagaacaaaataaaacaaacaaaaccaaaacctacagggactcttcatttcaggactgcaaggaatcaccagccaggctgagggacacggacagccagcccagc

SEQ ID NO: 470 - DNA, 387 bp, Homo sapiens
  Genbank Accession No. AA233347
gctgcaaacatgcagagatttcatttattttgtttggcacatgggaactacattttgttcctattatctgtgtgtttcactttgctgtgcagattttcatccaatttttttcaggggagggcatatacatttgtagggctgtatctatccaattctgcctgtaacaaacacccaaacatcctaaaatatcaattataagacagacaagtgtaatgtaaaactctggagaacatcaaagaaaaatggccatgcatctgctctttaatgttttcctacgatatattaaaataaaaacaaagtttcagtctcttcacaagaagtaatttatattctctgaattttttcagccacaacaactggattctcttttctgatttttgctgcagc

SEQ ID NO: 471 - DNA, 352 bp, Homo sapiens
  Genbank Accession No. AA233369
tgcaattgagacttagtttattccatgtttcccttgaagttcccttgaaggcgtgtgctgtcagttactaatagagctgtgtagaaaactcagtgacaaagtgtcattttgacctggagggctgcaggggctgaaagaatccagcattccccaaactggagcgaagagcaccatgagaccactgggggttactggctcaatggcagcccacggatgacaatgcacaaacctcatttgtgtgtgttcacattttgacaaagaatagcaccaagaacaacctttaggtaaacagtctcctcagcacattttttgctccctgaattgctgtgggcagcagttttcacttcagttt

SEQ ID NO: 472 - DNA, 421 bp, Homo sapiens
  Genbank Accession No. AA233763
caaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcaatcacacataaggaacatatgttttccagtt

SEQ ID NO: 473 - DNA, 539 bp, Homo sapiens
  Genbank Accession No. AA233797
gggttaaacagtatttattgaatgtaaagtaccccagccccatgggagagaaaattccaagaacggggaataatacagattaaatacccacctgtgcattcacactctcacacacacacacacatgccacgcacatatccaagctccaacggtgacaaatcaaacacctgtttcccccagcctgagggacagctggtaggaggtggttcagaggtggggctccaggatgggctctaatagcagcagccttgtctctccctgccccctgccctgccccaggggtcaaagggagctgggcgtggcgcataggaggttggcggcaactcttcccccactcctgccgcagaccgcttcttgggctcttgatctcaattcataggcctccttcaatgggagcgttgtggtccctccttattgggcccacgggtcacacagcccgtagggtcttattgggcctgtagcatgtgggctgcgtctttggctgctcgcttgccgatgaggtggctgtacttgtccttgtagtcgctggcagggctcac

SEQ ID NO: 474 - DNA, 459 bp, Homo sapiens
  Genbank Accession No. AA233837
ttttttttcacacagaatggaataaaactttattctttttaaattccacacataaacgagatgctgaaaaagcccttgccatctctgacagaaaagcagagcagctctgtttcatgaacgacagcacaattaaagctaaaataatataaaaataattcgaaaaaatcccttttactgtacactctcaaagcaagaaagagaaacaacagttttgttttgtttttttctgctagccagaaaatgtgtttctattcatttgggctttgaagttcagtgtaccccacatctgtgtgtctgtgtgtgtatgcgtggctatgtgcgtgtaatctatgcagtgtggaagcccctaatcttttcatctagtttgcctaatcattaagctacttaaccaattataatactattatgtcacattgaacaactttacataattgcttctttgaaatactagaaacattg

SEQ ID NO: 475 - DNA, 174 bp, Homo sapiens
  Genbank Accession No. AA233886
ctggggttctcaagatttattcaggatcgtgttaacggaggcggtgggaggatagggtccctgacgtgccggggacacacacagagaaccctccccgcccccgcaagtaggggggaggcgtcggtttttcttaaaaatataaatgtatttatctgcattatcacgtccctgggg

SEQ ID NO: 476 - DNA, 382 bp, Homo sapiens
  Genbank Accession No. AA233897
tttttttttaggacaacgtttgtttgtttttattttaaaaagtcaccatattaataaaaatgctacaaaacccagaataaatatcttcaagttacaaaagcaaaacaggtctagaaaagttggctgtaaaaaggcaacagagaggacagacccaaaagataaatgtctgcttgcttgggtggggctggtgctcaaggagggacagttgttggccctctcccccgaccatgccttagaagcatctccgccagtccagtgaatcaggcctgggtgataacggaaaaagttccatgcctgcaggcatcgttctgccatcactcaccgagcttcctggtctgtgttccccttcccagcctcactgttacccgtaaaaatgaggagc

SEQ ID NO: 477 - DNA, 255 bp, Homo sapiens
  Genbank Accession No. AA233959
taggttcaagttactcaacaattttatttacccattctacacacacgcacacaaaaacacatttcaaatacagttatgcacactttaaatggatctgagtggcatactttgttatcagtgtcacccgattaaatcagaatgttgctaaagacttatgttcctatttcaacagagcagtgcctaggaaatctacagtagaactctcttcctaggcttcccaatctgacccattcccattcaacccagaggtgctca

SEQ ID NO: 478 - DNA, 403 bp, Homo sapiens
  Genbank Accession No. AA234095
attaatgcaaacatatttttattaaagaatgaatgcatttatgctaaagaatagcttacatatgttgtaaagcaacaagcatatcttcaagaagtgagtcctcctcaatatgactccatgcttattctacatgcctgaaaactgggcccacacacaggggcacacgtacacgcacacaaacgcagatacggacacacagatatgcagaccgaaatgctgacaccatcgctctctagattggattagctctcatttaaggcttcttaggtgccgcagtgcccctaatattaccaggattgaaaacagacttttaggaaggagcagcattacttcgaaaagtagtcatctgctcttgtcctccaatgtgtgtattttaacaaataccatttaattctatgttgac

SEQ ID NO: 479 - DNA, 412 bp, Homo sapiens
  Genbank Accession No. AA234096
tggctaaaatattgctttattcacatttttgtccttggaggaaaatctaggcacactgcaacttggatcgtgtaaataaaggtacaaggaatgttttaagtcagaaaagggcatcacgcagtcagggggctgtgtggacgagctcaatttcgatgcatctcgggagacccgggcaagaggccgcttggattccgggaggcaacgccccacagtcaggatcccttgctcgccgcccccaaccggtcaggatccctggctcgcgtccccaaccggttccgtgtctcacctgggtcctgcaggcgtccactggaggaagccggatggctgggcttggtctttcaggaaggctggctggcaccgggcttccttctggctccagggggaaccgtacagaacggggagaaagggggaa

SEQ ID NO: 480 - DNA, 395 bp, Homo sapiens
  Genbank Accession No. AA234346
catgagaagtttgcttcaagtttaatacctttttccttttaaataacaagttagaatagctccataaatacaaaattaagcctctgatactatactcacacactcaaaggatgaacaaacttcaaaaataacatatttttctttgacaaaatcagtaaattggcaagcttgtcaaagaatcatttcagtctaacattttacttagtggataaatatttgtcaacaatctgtaaatagtataaatgcttttctcaaaatgctacgtgaaagaagccaggcacaatagattacacattgcatgattccatttatatgaaattctcaaacagcagaactaatgatagaaagcaaaccagtgtttgccaggggccaaggataggagcaggggattgact

SEQ ID NO: 481 - DNA, 387 bp, Homo sapiens
  Genbank Accession No. AA234362
gactaaaatgaatatattattctaggttaatttttttccattcaaatgtttatactccatctacccagaacaattacagcagaaaaaataggcacctccaaagtcttcccaagaatgatgactttctgaaatgacacactgtacaaactggacaaatgagacgactgactgtgacaggggccggggagctcttcaaggggccgttttcttcaagtctcggatctgtttaatcaagtagttcttctcgtcagcgaactgctcatcatccgtcctttctttttggaagctgctcagaaactcaatgagtttgggctgattttttaacaggatctccacaataggctgtgttttgtgaggactggccacaaacaccttaaaaacatgaaa

SEQ ID NO: 482 - DNA, 394 bp, Homo sapiens
  Genbank Accession No. AA234365
attttcaataaaattttatatgtatataagtaaataacaaaacaacaaaaaacaaaaaaagaacaaaacagcaccaagaacctatgtaaaatttcatcatacaatttctatgcaagctgcttgattacagaaaactgttcaaactgttcatcaaaaactgagtgggattttccattgatatttcagatattcaaatcaacccatattctgagtatcaatctgaattgcacaggttaagatgtgaacccttcacatagtgttgaagatgtgttgaaatctgtacttgaattggcattgttttcctcagagttaggctgccttcatgagaaatatcttctatccctgagagatcagctacatcaagatggctcatcagctaaatcacgttgggtca

SEQ ID NO: 483 - DNA, 397 bp, Homo sapiens
  Genbank Accession No. AA234527
ttgacaagaatactggagatttgagtcaatttttgtggtcttctgatagctaagtgccatcaggttagaagcaccaacccattttcacacagatgattgattaatgtttagagtttatttgggaaagctacgaactagctgcccatcttaaacagctgtacaataacttgaataaaaaattatgtaagaaaaaatgagcaagcgtagttcactaaatataaaggaaattgttaaaaccagacagtaatagctataaaaggcacaacttcccttttctgatatacacttgtaaactttttttcaggtttccatgcataaatcaaaaatgctatcctaactatacaggggggggatacaccaacagaaagtctagaaaatttcatccagccaactgtga

SEQ ID NO: 484 - DNA, 416 bp, Homo sapiens
  Genbank Accession No. AA234530
ttttttttttcaagtatatttactctttattgcattccttcatttgcattaaacaatattttttcaatacagttttggacaaaacacaaagacattaagctcatttaacaagagacataagttaacacaatgtgtgctgctttcatgaggaggaaagaggcaagatcttagaggaatccaggatactggccaccaggaatcacaggatctcacaatacaatccacttctttaaaagccacaaaataagctagggaagaaaacccaaaacaaagaagatatgacatccaagtctccaccaaaagtatacaaatggcaagatttggagatgatctgctttctcacatgaggacaaataacagaggagccacacccaagtgccactgtggccacaagcctcatgggtggcgtgtgaggt

SEQ ID NO: 485 - DNA, 389 bp, Homo sapiens
  Genbank Accession No. AA234561
gctcttttaatgagtttattctgtcaatagggaaaatatcaactttaaaatctaaacatatgccacaaaattttgggacaaattttgagttgaagacggcagtacaaactcatgtttagctttgtacacacataaataattatagatgtgtacatatgcatggattaatatacatacatatttctcaactctgctacaaacagtgacatcccagtagcaacaagcacatctaattgcccagatcttggtttctaagtatgattctccaacaaaaggaaccagggctctttggagcaggggttgattctagggattctattgttggggcagggaatatccaagatgaacctggagcatcttgtagtgccagaaagtaagaagtgctcaaa

SEQ ID NO: 486 - DNA, 103 bp, Homo sapiens
  Genbank Accession No. AA234634
cagctcacgcgggacctggccggcctcccgagtctcttcaagcagctgcccagcccgcccttcctgccggccgccgggacagcagactgccggtaacgcgcgg

SEQ ID NO: 487 - DNA, 558 bp, Homo sapiens
  Genbank Accession No. AA234687
caggagtttaaaacaacaaccccaacaacagaagccttgcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgcccttttttttttattttgaatgggaagttctcactaaaacaatcctgagatttcttaatttcatggttctttaaatattataaacacagagtcaacatagaattaaattgtatttgttaaaatacacacattggaggacaagagcagatgactacttttcgaagtaatgctgctccttcctaaaagtctgttttcaatcctggtaatattaggggcactgcggc

SEQ ID NO: 488 - DNA, 263 bp, Homo sapiens
  Genbank Accession No. AA234706
tccaaacatttgtggcagtcaagcttaatgaattccttttgattattcatctctgaagaagtgctggttgtccagaacctgatatttgtaggaggtttatgcagaaggccagagtgcctccagttctggactgacaactttttcgtgattcagagatttacctaagagacagtttagcattttacttctcaacagccaatgcagacaggcagtctggaggtttttcacaatgcagtcatctcctccccaactgctatagagat

SEQ ID NO: 489 - DNA, 427 bp, Homo sapiens
  Genbank Accession No. AA234717
tttagttttttaaaaaatttaattttcttgtggcacataacaatgaactctggtgtcaccagcctattgtataattaacttctcgtcttttgttccttatgaatttacatatttaattatctttccatttaatttcccatggttttgctacgttgactaaactctgtaatgagaaagtcttttaatttaatagactttgcaggtcatgtgtaaccagctttggaaatcattttaggattactgagtgctgtttcataatgctgtatatttttcctgccaggatttggagtacctaggttatttgtccaccagaacaatggctgtaaaggagaaaattgagcagtggtcagaagctgctgagaagatgcggtaaaacaggttacataaaaaacaatgctggtttgaaataacctatgcgcttttgtca

SEQ ID NO: 490 - DNA, 429 bp, Homo sapiens
  Genbank Accession No. AA234817
cctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgtgtgtttattttattcaagtttgaatattgacaagtgtaacttaagctggtgactgacacctattgatctgctgtgtgcaaatgatagtactattttttagaaaactcttaagtaaattttaaaaatatttgaatacaaaatatctgagcaattttgaactcaaaagtttttcattgttttaaggattgccacaggactctttaatggtttttaatggacatacatgcctaatatttattggtgtgttaaaatag

SEQ ID NO: 491 - DNA, 185 bp, Homo sapiens
  Genbank Accession No. AA234831
ttttttttttttttttttccaattttaacatagaactttattgaaaacacagactcaaatagagaaccatatatttaaacaacgaatagcagggtagcttacttaggtgacacagttcattgaaaacttaatactgaaaaataccgcaatctggacagcaagacaaatatcaacaaatgtgtttt

SEQ ID NO: 492 - DNA, 456 bp, Homo sapiens
  Genbank Accession No. AA234916
taagagagagggtctcgctgtgtcgcccaggcttgggtgcagaggtgcaatcatagctcactgcagcctcgaattcctaggatcaagcaatcctcctgcctaagtctcctgagtaactaggaccataagtgtacaccaccatgactggctaattttttacttttccgtagagatggagtcttgtgatattgcccagcctggtcttgaacttttggcctccgacaaccttcccatcatggcttcccaaagcattgggactacagacatggactagctccatttcttgatgtgaggccataagcagaaccaagcagactcaaggcccttggttgcttggacacaattagctattaataacatccaggaaaaagctcagtcttctgagtcaggaaaacctgggctggagtcctggctacactggtcaccagcagcagaagcctgggcaagatgcttcac

SEQ ID NO: 493 - DNA, 385 bp, Homo sapiens
  Genbank Accession No. AA235233
aaatgaaatctatgaatttttttattaaggatttgataagctgatataatgaaaacatgtaaatgaaaaacatttacactgactgtacgactagtgtgctaagccattacaatagtttactgacataactggcaagagtaacttggaaaataacttaatccagcagaacaaaaacatcctcagaaaaacatcctcagtagtactgaatatatctctctcatatatctatctatctatctatctatatatatatatatatatagctttgcacaatcagggagcaaggcaccataatgaaatgagcatacatttatgcagaagaaaataatagcaacaaagctgcgagaaaaattgtaacttcatcttcactgagctgtgcataatc

SEQ ID NO: 494 - DNA, 366 bp, Homo sapiens
  Genbank Accession No. AA235288
aatttaacaagttgatatatatatatatatatatatatattatcaagtataacacagtcatacaaaaacatttagtagaaatataattcacacataaaaacagtctacttattttttgtcccttttatatcctattttaggcaaaatgataaaacccagaaaataacaggaatgtactagtcctaaaaactggaccttttataaatgaaacagatccgatcacctataccttctctcaaattccaaataatgaggcttactgacctgtactctcagaatcaacttaaatacattttagcttgatttggatgaaatatgtactttcagttgttgacaatccaggtagaacaagtacataaaatgatt

SEQ ID NO: 495 - DNA, 359 bp, Homo sapiens
  Genbank Accession No. AA235289
tcaccctctaagcttaatgccagttattaaacacttggggggctaccaatgatttcataaaagtataaaagacactttaataatttaaaaaaaaaaagtttttgatacactatattctgcagtatagattcttagtataggcaattatctctgacttgtgccaaattcttaggaacaataaacacacatgcacacacaaacacacactcttctctcagttacacacgtaagaccagaggttacttgcacaagactgtgaaaccaacaaaatgtggggtggtgtatagatcgcaggctcagtgatattgcagttctgaaggccaaattcttctcccaaggcccagctcaagataatcttt

SEQ ID NO: 496 - DNA, 139 bp, Homo sapiens
  Genbank Accession No. AA235310
tcaacaaatatttattgttcatcaaagacgagccagattttatgggcatttgtgatggaggctggccttagctttaggagaaggaactccaagagcagtagtgatctctgagatcaccttgttcaccctcctcggggca

SEQ ID NO: 497 - DNA, 230 bp, Homo sapiens
  Genbank Accession No. AA235448
ccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaagggttttata

SEQ ID NO: 498 - DNA, 183 bp, Homo sapiens
  Genbank Accession No. AA235507
gtgtgtaagtcaacagaacaatcatgacccagaggtgaagcaaagccatatatataattacaaaaactcgcgctatggggtatcttcggagaaaaattcccaggcgaatactaaactgatcaattgaactagcagctttgcgaacttttccgtacattcctgccagattagtttctgtgtcat

SEQ ID NO: 499 - DNA, 382 bp, Homo sapiens
  Genbank Accession No. AA235618
acaatttaataatttattacattacagtggcatcacaccagcagtcaataaggccactctagggaaaaatctttcagtatttccatgacacattctgtttacaataattcataaactggtaaaattcattctaagaaaacttggcaaatgaaactttggactggaattggcatttctttctctgcttttcgttcccaccatttctttcttttatactacagtattcatattttaaaatgttttaaattatttcagaacattaagatagcagttacattttttaatagttatattattttaaaatgactctttaaaataaagttttagagaaactatattatggatagggctgatttacattttcaaattttctaaaatcagc

SEQ ID NO: 500 - DNA, 412 bp, Homo sapiens
  Genbank Accession No. AA235707
ctttttttacttatttaaaaaggccttggtggcaggaatatagtgtaaaaatcattggaaaaactaaaaggcatcgatacatatccgaatatacattttgtacataaattacatttcctttagtctttctgagtgaggtcctgattcagtactgaggtctagtaattaagaggtcccgggagctgcacgttcaggccggcatagtccaccatgtacattggccattgcacgagtgagatctggttggccgatgccactgaatccgggttagaggacgaggaagaggaagacgaggaggaagaggagacggaatttccttccgagacccgctttctcttgcgcttgggaatgctgctgtctttggctggcaccttggcatcattgcagatttctgcaaagggttggagctggt

SEQ ID NO: 501 - DNA, 362 bp, Homo sapiens
  Genbank Accession No. AA235765
tttaaggatttccaactaggttttattttagtttccaatattatgagcaatgatacaggagtaactcaagcaaatacatcaccttaaatacatcagagaaaactcactgtgtcagcacgtcttgcgctccagcaaatgaacataaaaacaacaatgtcagcagcattaaagtgcttttggccatacttctttcagaaagggtctctccctcagtggtataaatttaattttacgtattgaagaagctcaaaatttcattcattccccaggggctacattgaaaaaaaattcatgtttacgctaaagaatttttttttttcaaaaagagcacaaaatccattggaattgtgtgacagtgattt

SEQ ID NO: 502 - DNA, 401 bp, Homo sapiens
  Genbank Accession No. AA235811
tatgcaacaagggttgtcattgcaactttattattagagcaaaactctgtaaactatccaaacactcaaaatactgcaatttgctttataaatgatagtctatccacacaatgggatgtggtgatttaaaataatgatgtgtataattattgacatagaaagaaatttagccatttattaaatgaaaacaagtatgtttgtaaaacggtatccagaagacaaaggacccagtttcttcaacataacagtggcatgtgaaccaaaatgtagggggaactataataaagaggcttaagaaagaagaaaaaataaaaaataaaacaggcttaatatatcaaccgcatgcaatatgtttagatcctgattccagaaaagcaagtgtaaaaaagtaaagttttggc

SEQ ID NO: 503 - DNA, 315 bp, Homo sapiens
  Genbank Accession No. AA235853
ctcactgcttttgaggctttttcgttgcaagcaagggcttttgcattgagggaaaaggaagcacagaacggattcatccagggtcctggagaggagggtgtggaggcaagaagcaggaaggacaagtcctcctctcggcacgcctgggtccccaggactgctgaagcacaagacccgaggagtggcctggtccttccctcctggcctgtgtggactctgatggggctgttggacgcggtggccttcaacctggggcccgttggccagagctcggcctctcagagaccgctgcaggccctgcctcgccgcctcctg

SEQ ID NO: 504 - DNA, 401 bp, Homo sapiens
  Genbank Accession No. AA235868
acaaaacaaaaatattttaatacctttaaaatccaaattttcctttaaaatcattcatgaaaaagattctcaagtcagaattaacacctcaattagtcaagcatcaggaagctacattacagctattaatatacaaagatacatcttttcaccagtctttccttctgatgtctctgttccagaatcatacagactctcatttctctacactccccattccatcatttcttcagatcatgaaaactgaatttgctgaacaccagaaatctgttgatatgatgttgtgtaaaccataacattttgttgttgaccgtctgtggttattaagccagctggtaactggttagtaaatgcctcctctgtaagctcttcacttagtccatctgtagctgtgactgctc

SEQ ID NO: 505 - DNA, 404 bp, Homo sapiens
  Genbank Accession No. AA235873
agttctccaggaatctaatatgggtgctttttaagaagagagccaccggtctcagctaataatacaattttcacaaataaatccaaaatttaaggtaggattaaaaaggagtaaaccaatacataaaaaatgaaattgagaactgatttaatactaaagttctgaataaaggtgtgcactttatgattgattctatctttttgcacaagttggatactccagtttcccatcccaacatgttgttcgcaatgtgtgagaacgtgatgaaagacgatatccccgtttacacacaaattcaactgattcacctgttctcgaataaagcttctgtttggctgtccaccttaatgctatgttataattttccataatttctcgggatattacacacggatgtaagcatt

SEQ ID NO: 506 - DNA, 271 bp, Homo sapiens
  Genbank Accession No. AA236037
tggtggcaagtgagatttatttaaacaacgacatgtcaacaggaacaggaagaggaacatgtgcgaccactgtagtgaccaaggcttctcaagagtgtgggatgagacctgcggacgaggcccgcccaccgctcagggagcttgcaggtctcctccaggagggcaagtggcttcggcttctggctcggcataagccttcgacagattaataagttatctccttcagcccaagctcatttcctcctttggttgcccagcaaaggcagtaatg

SEQ ID NO: 507 - DNA, 364 bp, Homo sapiens
  Genbank Accession No. AA236150
aaaggggaaaaaaaaccaggattaaaggtgattccaactggtaacaacaaatataacagcttgaaaaactcatgacacagacgcataaatataatataaaaagacaattttaaaattgtattgtaggaatataactataataagtggaaaagatacattaaaaccatcagtgtgttacacttgttcaaaacagaactcataaggcagaccaaaactgatgcaagttaaggaaaatggtctgtttttaggaagcatgtccagacagacaccacaaagaaatgccaacagagactatgtggtcccctcttgttactagtaatgtgtcaaaggtggagtgactgggttaacagcctaagctttctcc

SEQ ID NO: 508 - DNA, 334 bp, Homo sapiens
  Genbank Accession No. AA236230
ttttttttttttttttttttttcagtttttaatttttttaatgtatctatttaatggaataagttgatcatagatttgtaaaccaaaaggtaatttctcaagtatttggaaataagaaaaagcctccctaccaccaaccttttggtcatctttctcattctcttacaatcatcctaatcccctagtacacccttaccatatatcaataagggcaccataatattatgcaaagaacagatatatatgcctgatctcttattagacttgcaccagagactgttgaaccactccaggcatgaactccaaagctgaggcacactgaccaagcccctgg

SEQ ID NO: 509 - DNA, 388 bp, Homo sapiens
  Genbank Accession No. AA236365
tgggggtaggctctttattagacggttattgctgtactacagggtcagagtgcagtgtaagcagtgtcagaggcccgcgttcagcccaagaatgtgggatttctctccctattgatcacagtgggtgggtttcttcagaaaagccccagaggcagggaccagtgagctccaaggttagaagttggactggaaggcttcagtcacatgctgctttcaagctttcaggctgggcaacaaggaggagatgcccatgacgtgccagggtctccccatctgacaccagtgaagtctggtaagacagcagccgcacgcctgcctctgccaggagggcaatcatggtaggcagcattgcagggtcagaggtctgagtccggaataggagcaaggg

SEQ ID NO: 510 - DNA, 316 bp, Homo sapiens
  Genbank Accession No. AA236401
agtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggat

SEQ ID NO: 511 - DNA, 453 bp, Homo sapiens
  Genbank Accession No. AA236412
aaaatagtgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtc

SEQ ID NO: 512 - DNA, 401 bp, Homo sapiens
  Genbank Accession No. AA236455
tttttacgaaaccaggtttattaaaatttctctacaagtcagaaacggccatctcactgttcacatatatacacgtatgtacaggaagaacctagtgtttctagctttcccggcagaaggccctgccagcccagagtccttagtcggataatgtatcacagatacaacagtcgagcaaccacgagagcgttagtgcgacagaggcctctgtcctccctcttctcaaagtcccatgattctgtcaaggtaatattgccaataatcattcacatttcacgtggttttagacacgcaggttattcagacagacacagacaacaaaacaagcctcaaagccagaacaaaacaaaacaaaaccaaatcgaacataggtataaaaggtaaaatatatgtacaaagta

SEQ ID NO: 513 - DNA, 353 bp, Homo sapiens
  Genbank Accession No. AA236532
gttatttaaggatttgtttaatgttttaaaattcaaagcactttaaattattttaagacaaaagattaataaaaacaacattacctttcaaatacaactttataacagcacagtggaagaatggtaaacagtccctcttttttttaaaaaaaaatcagtacttaaaaccaaaggaaggcttatatgtacagctaattcagaaagggaacaatgacacctaaagacatagataaatgcttcattttaatccaataaatgtcctacctactggatcttaataatgatgttttcaatatgccatttaaaataaactatccttgaaaataaagttttaaatcattcaatataatcta

SEQ ID NO: 514 - DNA, 447 bp, Homo sapiens
  Genbank Accession No. AA236533
aaatcattcagtttaaggtcactagactttagatgagtgaccctgcaggtttataaggcattctgctcagcagtcttgtaaatagtcctatatgaaagagccatgctactgttggacttggtcccactctggtcaaccttgataacgtcatacgtggcttatggactggatagcactggattccgccgcagccctggccatactgtgccacacgttggaagaactgtgggatgtagaatggagggactccttgtcagacagtgacagcatcatagcatatgcctgcgatttggactttctgtgtaacggctgcttaagttcctctggcacatgggaagtactaaaagaagacagctcagcttcagaatattgattatcttccattttcctcattttgagggctatctgtgaagtgccttatatgatctagagcagaaagtccacttt

SEQ ID NO: 515 - DNA, 151 bp, Homo sapiens
  Genbank Accession No. AA236672
cattaaaaaaccatttatagtcatttcatgttggttggaaatcacagaaattaggcaggaaaaaaaaacccaagggaacaaatacaaacagcacagcgttccccacagttctctgctctgctctcctgcgagccggggaaggagaggggca

SEQ ID NO: 516 - DNA, 319 bp, Homo sapiens
  Genbank Accession No. AA236714
tagcattttggttatttttagttaaagaaaaacagctttctccaagggcgacaaagtgaactgaaggtcagaaggaagctgggtgcgggcttcctgcaagctcttgctccaaaacctggaattaagaaaaggccgccccgaagctctgggaaagtttggtacacacggggttcccttgtgggggagaaaagccgccaagccacacacggtcactggattggtgtgagtgggttccaagcgactgccatgtgctagtccactgacatgattgacattaacattcttggggggcattaaattaaggaatgacacagggagc

SEQ ID NO: 517 - DNA, 531 bp, Homo sapiens
  Genbank Accession No. AA236796
ttgcacaaaggctatgtcaacactgaacacttatagagagtttaccactctagaatagaaggtataggaaagctgtagtcctggtcttcatcttcctcctcttcctcggtgtcttccgaaatggagttgcaagatccggagtgctttacttccagtagcacacctgaggagcaggcagcttccttcatggcacactcgctggcataagtggcattgtcactggcacagacaggctcatccgacttactgtcagggcacagctcatcacagagggaacaccggcctctcccaaccttgaaatcccataaacattttttcccaccagtgcactggatatcttcacaggactttgctttgatacactttccctcataggctaatccaatagatctgcccagcaggcaggtagcctttctcaggtggcaggcactggagtaggtgactccatcattcccacagagatattgctcagaggaagcaggctctgggcaaatccgattacaggtcacacagtaggcattatcctcgtgc

SEQ ID NO: 518 - DNA, 459 bp, Homo sapiens
  Genbank Accession No. AA236904
ttttaagtatgaaaataccatggctttatttttctcttaaaaagatagccgtgcttatgagctaaatggaaaggatgtatgtcattctcatcagtaaacaagatttaactgctttcagatgcaaaccataatgccgaagaagtgacatgaaggggataaaagtctaatgctttcatcttcacagcaatcaaatgcaaagtaaagcaaaaatgaaatggacttaattaatgctgggcattcccacagggaaaacgcaagaggatattataacaatcagtagcagtattgtatacaatttaaaaattccattaggttgagccaccctcactcctctctctggctctctcccatctgaggtatagcaggctggaactaacagagctagtagtcgggagcttttgctttggagtccactgagataagtgagtggcaaagtcttggaagaccagataatctggc

SEQ ID NO: 519 - DNA, 417 bp, Homo sapiens
  Genbank Accession No. AA236942
gggccgtgagacacaggttttatttgtgtgtgtgtgtacaggtatatgatgaatatatacacattcactcattcattgttggatttcagaatgacattttcaacaattaaaagtgaaagttaaaatttttgagattagaggtactatgaaatgcatctttccagatttagagagggtaagagaacacatgccatctacatattactgatcaggagcaaaaaccatagacctaagcttgacttgcattgcttctgacccaagtagtaatgattttcttataaagatttgtaaacatttcagttgtatctataatacaaattttagtcaacaaactcctatacctgtgatggttttaatgttcaatatccagttattaattaaaaaaatgcttaaaggtagacagatctgagaggcatg

SEQ ID NO: 520 - DNA, 392 bp, Homo sapiens
  Genbank Accession No. AA236982
acatgataagattatcttttattagagatcttatattacatattcccaaaaagatataaaatcttccaagagaaaatatcaaaacctgttgattccaaggtgaacaaaatgatcaaaatgaaagcaaacattttcttccagacaaaggaatatcaaaacacttcggcacaagtacaacaaaggcatgggaagatcatgataatgttttacatcacattttacagcattttattttaatcagtatttgtagaaaacaaggatgctgagttcttgaacactgcagtcacaaactcaaactaaaatttccaaaaaaaggaaagaaaacactgaactacttggtcaactgaacatctgtaataataaatgtaacgaaacctaaccaaataaatatg

SEQ ID NO: 521 - DNA, 469 bp, Homo sapiens
  Genbank Accession No. AA237017
tttttttttttttttttttttttctgcttaaataccaatttattgcaaaccaacaccaaggagctggaatagctttgcaggctggacacctcactctcctcgggccctggacaagggaaatgagtcaccccgctttcctcggacctcagctggtgggacttagtggctggccaaactgcggctgttgtgtctaaaaagagaaaacaggcagggtgtgccagctctggagactgggccagtccagggtggtggctcagggcagagaatcacccaccagacagcgtggctcaacgggagcaaggcgcgcagggacaggctccacaaccacaccaagcaccgcagtgtggcaccgggaccagatgcaagtgctgttcctgccatggggccaatacccaatactatccctcagtcattcttcctagatattggtttgctgtttattaaagcagggcagggagtggggagaaat

SEQ ID NO: 522 - DNA, 495 bp, Homo sapiens
  Genbank Accession No. AA242757
gaatgaaacaatgaacacatgaagtctccatttattctgtgatgggttagagtaagcctctgaggctgccatcaggctggctgagttgttgcccaacattgtatccagcagtctcaggcccgcgcagtgcacagccagcatggggctcacaggtgcagatggaatccagaagctcccaactatgctgcaaaggccaggcctaggggtccgggtacatgcagtgagtccttggggcagggcagccctgtcgactacacaagcaaggttggtggtgagacaaggggtgtatgtttccccgccaggacagagggcaacacacaggtgggtggcgaccctcaaggctgacggcatccctgcccagagtgacgaccagggcctactagctctactaaatttcagggtggcgaaatcctggatgttgcccctgtcatggctcaggggcctcctttcatcctagttcatgaagccccaacacttcctccctgggatcagtac

SEQ ID NO: 523 - DNA, 371 bp, Homo sapiens
  Genbank Accession No. AA242766
ttccgcaacacacacaaagaccggcatcagatttattattatctcttgttaaatattttcgatcttttctcagaacatggtctagaagggcatagtagtttttttcccggtacatgcgtgggtgggtagtgaggagaagggagcagaggtgcgcgccaggagccaggctggttctctgcagagaacaacctccagatcctcccagggaagcccgacacgccagtcccacgttggacgacgtgcagaggaagggggaggtccacggggacgacgaagatgaccttatacgtgcactcggcatatcctggagtaacgcgcagtgggggaggtggggaggggagggtcggccgggcaagcccctgcccgctgcg

SEQ ID NO: 524 - DNA, 379 bp, Homo sapiens
  Genbank Accession No. AA242822
tttttttttttttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccatagg

SEQ ID NO: 525 - DNA, 191 bp, Homo sapiens
  Genbank Accession No. AA243133
tttttttttttttttttttttttttgacatagatacttatttatttgcatatttaaagtttacacacatgctatgactccaatgttttaaaaaaataagcccttaacagctctgagacacatggcctcttctgtatcccaagcaaatccctaaatggaggtagagcacgtgttcctatttttcacactctc

SEQ ID NO: 526 - DNA, 354 bp, Homo sapiens
  Genbank Accession No. AA243173
aaatatagagcccaccctcccgcctcctctggggagggagcagagggctgggcagtggtcggggagatggtccctcagaggtcgaggagctcgcctgggcgtagacatcctccacaggaacagtgaggaaagctgggcgctggcttcggcctgggcctgggacgggtgggggtgggaactgacccctgcgctgcctcagaggctctgggcagccagctagcccggtgcgacccgctggcagaagctgagtgggaagggggcggcggaggagatgaaggtggcgtgtggctgtggcctacgcatccccgttctccatgcggcccagctgctcctccaggcggcagatgcggtcgc

SEQ ID NO: 527 - DNA, 393 bp, Homo sapiens
  Genbank Accession No. AA243466
gtctaacatttatttttttctttttccccagaatcctgaaacacaatagtcttttagtagaagaggtttctgagttctttctaagcaactactctaaaaaatcagtagcttctaggtggaatcatacagtttccataaatggtcttattttccttttctggttgaaatttaacccaaagaactttaaggtctaatgtgatgcagtatttacatacaaaactcttaattcatcctgcaaaatggccaatatgagcagataaataggaaagctatgcatctaataaagcacagggccagtgctctataaagattattgagttgtaaacataagatatctattcaaaagagaccactgaaatggttggggccaggttaggccaaaacttaatgcat

SEQ ID NO: 528 - DNA, 422 bp, Homo sapiens
  Genbank Accession No. AA243495
tttttttgtagttgctcatgaaccacgcgttttaataaaaggaacattaagtaaattgtaggtataaaagaatcagtgcatatctgttaatgtcattgacaataaaaatatattatcttctcagctcagctctaaattaacaaaacacctattttttttttcccactcctcattttagtggttctcaaacattggtgtgctcagaatctcctgaggtgcctattgaacaatgacatcccaaagccccacccctaagatttgattcaggttgtctgaaaccaggcgccatgacccagatggtccatggatcatactttgagaaacactgatatccccttaatacataacaaaacattgtttactgtttatgacttcatggtaaagttttaagctgaataaaacattcaaacaattattagaac

SEQ ID NO: 529 - DNA, 418 bp, Homo sapiens
  Genbank Accession No. AA243582
ttttttttttttctggttgcacatgtttgttttctttattgaaagacaatacagaattgatgaaacaatacctcaagggtcttgaacatggatcaaatgacagaagtctttaatgcaatggcacagaagcttctggcatcagcacctgcaagccctgttcagtcatcattcatgatcgccaaatactccttctggtgttcaaccagcttcaggaatacttggtatttcttatcatagtattttttatcctgtagtctcgggaacacaactttcccaactttgctcatttttgccattgcttcctgtacagaagcgaaatcccctgaggcacaggcacccagaacagcagcacccacaagaacggactccacctcttgcgacaggaccacaggcatgccagtaatgtccgcatgcattt

SEQ ID NO: 530 - DNA, 311 bp, Homo sapiens
  Genbank Accession No. AA243595
tttttttttttttagtttgtaacattttattgcaaaaagaagggcagagaacagtctttttcttcgtacctgttcaccgcagtaatttttagcagctctcctgtgcaaagaagtctaatcaatgaatcagcgtataggccacaaataccttctcagtgcggtttcacctagaatacaagcactcagaagcacaaatttaactgaagtgagaaaccaggccattttgtagcttcagtttttctaccagtaatatattaatttcttgaaatagcctaataatttagttctactatcaaaacagaagcccaatc

SEQ ID NO: 531 - DNA, 268 bp, Homo sapiens
  Genbank Accession No. AA243598
ttttttttttttacaaaaatcacctcttggttttatttctttttatattagtttgatacgtgaatgttagtccaacttaatttttgaaggagaaacaaaatgaaaaatgttttttaaaaaacaaacagtggtatctcttgtcatgagttggatgcctgtgactgacatcaggtattgccaagtaataaacattttgccattcaactctaaatcccttattagcattagttttaaaggaaatgttacagcttttatattatttgatttg

SEQ ID NO: 532 - DNA, 391 bp, Homo sapiens
  Genbank Accession No. AA243654
ttttatgttttaagagtatttattccaaacacaatgttcactttaaatgcaaaatagctggtagaaaaaaaacactgaaaaatatactgaccctttgccccatatacagacatcagcctttggtatttgctttcaggtaattaggtaaaacaaacaaacaaaaacttgaaactattatttatctccaagaaaacaacgtagagttgaggtattctatttaacagatgtgatctccatccaataaggtctctctgttaattaacagccttgtgacatgctgttccaatcctttcctcctaaagtagaatttcatttgagcatatgttcataaaactgacagtgttccttaataatcactaaggttgccatagaaactccctggtgctggtgc

SEQ ID NO: 533 - DNA, 362 bp, Homo sapiens
  Genbank Accession No. AA247453
cttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgc

SEQ ID NO: 534 - DNA, 411 bp, Homo sapiens
  Genbank Accession No. AA248283
gaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggttctgtagggaaaattcagtgacgtacatgg

SEQ ID NO: 535 - DNA, 283 bp, Homo sapiens
  Genbank Accession No. AA249819
gaacccctaacccccaatacttgaagggggtttgtttttttactaatgatggttttgtgggttttttttaagggatgagtggatgagaggagtaatagggaacagctatcctctcttgagaaggggaggataagtaggctcggaacttcaaagccttccagtcccagcacctgcctttctcactacttctctggagatggtaggagagtttctaggtctttcagggcagcatgtgattcattttgggatggaggatctctccccatcggataaattatatcaa

SEQ ID NO: 536 - DNA, 503 bp, Homo sapiens
  Genbank Accession No. AA250744
atcattgataggactaaactgtcttcaacttactaactggagtttctttacccagcagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggccccggcagcacacggccacagcgctccttcctctcaagggtggtccgggcagccctacccctgcagctgctcctcctgctgctgctgctcctgggctgcctgcttgcctcctccgagaagaa

SEQ ID NO: 537 - DNA, 460 bp, Homo sapiens
  Genbank Accession No. AA250775
tttttttttttttactattattttcagccactttattaactgtggggttaaatggcaggatagatgtaacacccattttacacgtatgttgcaacatcagagatgctggttttctttaaaaacatcagagctgaattccttctaaaatacaacaacaacaacaacaacaaaataagtacacttggtaccttggaaaatgctgaaatgctatcatgaatgctggtatatttgttatgagccaacagaaaattacctttaatataaactataacttactgatgtgattgttcttcctatgtaatctatacataatcaaagtgagtgatttctcatgtttagcaaattgttctttaggtaatgaaaaacagtattctcattagaaaaacacaaaaatccaaaagatttatcgcagcaaacgttctagtattttaaattttgaagttacttttggaataaagtc

SEQ ID NO: 538 - DNA, 410 bp, Homo sapiens
  Genbank Accession No. AA250958
cagttgcaagatttaatagagtgaaatagagtgaaaacagagctcccatacaaagggaagggacccaaaggcggttgccgttcgctggctcgaatgcctgggtttatattgcaatccttgtccctcccactgtgctcctcaggcaatagatgattggctatttctttacctcctgtttttgcctaattagcattttagtgagctctctgattggttgggtgtgagctaagttgcaagccccgtgtttaaaggtggatgcggtcaccttcccagctaggtttagggattcttaatcggcctaggaaatccagctagtcctgtctctcagtcccctctctcaacaggaaaacccaagtgctgttggtgaggttggctgatgaccactctaactgcttcctgctgaactgggg

SEQ ID NO: 539 - DNA, 464 bp, Homo sapiens
  Genbank Accession No. AA251114
ttttttttttttctcacttccctttttatttcctctaagacttgcaagcagcagcaccagagagggaacctgccctcctggccctggaagggcggacccccaacccctaacccaggacacagctggcacctcaggcccctttccttctgaaaggagggctgtgtctctctcacattcacacatacacagacacatgcatgtgtgcacactcatggcacatgggacctcaggggtagcctgtttgccgatccccccaagaggtaccaggaggcagaccgctagaaggagataagaggcaccctggtctcctccaacccaaggaggaagaaagctcaacccctctaggatagggactgtcttcagtcaatggagcgttgacttagggggcgtttttgaaggttttttttcctcctttttgcagtctttacaaaaatagaacttctcttggtatttataaatctacg

SEQ ID NO: 540 - DNA, 348 bp, Homo sapiens
  Genbank Accession No. AA251230
ttttttaggttttcaaagattttattaaaaaaaccaaagatatataacactaggacgggaccagcggacttgggggcagctcccagtctgctgatcagtaccctctgtcccagggctccacctggatggtcctgaggcccaaaccctgcctctcagctgcctcctgccctacaaactggtgactgctctcatccagcttctgatctgtttcatttaagatgattaaaatactcccctccccaattcgcttaaaaataattttcaaagattaaaaatttcatttgtgtgtgtgtgtttttttaaataagaactttaaatgtgggatatctccttcttcccctaggtcca

SEQ ID NO: 541 - DNA, 256 bp, Homo sapiens
  Genbank Accession No. AA251299
ttcaaaggagaaaaccagaacgttttattagtttcttgaacctatttatagtgtcaaaagttagacgcaggtgcaggcctccattccatctattggctggctctcgactgccgagactggcctgccaacctagtgtttcaggagggcacgcgtctgcggctgaaccgcggaagggccggtgaggaaccgggcctcggcgagatggccctgacgcgcccgacactgctgccgctgctgctgctactactgccgctcc

SEQ ID NO: 542 - DNA, 243 bp, Homo sapiens
  Genbank Accession No. AA251428
tttttttttttttttttttgcacaataaatactcgccagtttcattattattaaagaatccatttgaatgtcagctcaacacagcctcctataccgaggcattgtgaaccgcatctccccagcttctccaggcttttccaagaatcagggacactgtagcctgttggtctcagtgtatgacagacacggaggaagcacatctttagctgatacttaaacagagaccctgagcgcacatacacc

SEQ ID NO: 543 - DNA, 436 bp, Homo sapiens
  Genbank Accession No. AA251766
acacaagaacttatgtttattgcaaacaaacaaacaaaaaaaaaaggaaagagaggaaaagagaaaatggtcagaagcacaacatataaggttaagaatttaaaagcatcttacattctgccctaatggcagcataattaatagcaacaaacggccgtcttgctgcctgccgcaccggaggtatttttgcagacctgacgagcaaattttgtgaaatatgtagtatgaaggaagaaagcttggcgggtcttcactgcagactttggactcccagtgtttcggactggcattccctgcatggcctggcgggacacgtgacttctaacacgagggtcctctgtagttgggctaggagataacttctcttcttctgactgggtgggcattttcaacctcccaaatttttcccataaagccaacaaattgcacatatcct

SEQ ID NO: 544 - DNA, 372 bp, Homo sapiens
  Genbank Accession No. AA251769
ttttttttttttttttttttttttttttttttgatagccaaaagcaatttattatagtttagcctcaaaaaaataaaaataaaaaaattatccagtggttatgaggagtctaggaaaacctgtcccagtaatgccaacttggaggtgaagggctgactggggcagctgagaagtgggaccttctgtttggcaggcttcctctcccttgcctggtcatggttttctggtgagaagagtgttcctggccttgctggaggttcccatggccccgaactaacagtgtttttctgaaatttcgacctgctccgtttgagagagtagaattccctcatcaagtcctccacctcccactgctcttccttcagcctctgg

SEQ ID NO: 545 - DNA, 350 bp, Homo sapiens
  Genbank Accession No. AA251776
aagaaaccaatctgactcccaaccaatggtttgcgatattaacaaaggccacaaacagtacacctgggccagcaaacagtgtgaaactgacaaaactccaagggggaaacatctagcaaataaatcaaaaagccaaagatcattgctggtgatattagcatactagaaacccttaatatgctgctactatgatttgttttaaattattgtttagtcatatattaaagagccagctgatgctcttacagttaaaaaaactgtgtagccacattactgttttcaacgtcctgtgtggaaagttgctatcactgtacaattttgcttgagcctttattttacaacagggcttt

SEQ ID NO: 546 - DNA, 343 bp, Homo sapiens
  Genbank Accession No. AA251792
gataacatgggtggatttatttcttaagatttgagtgcaaacttaaaaacaagaacaaacaaagcttttcatcaagaataaacacaaaatctaaacaattctgcaatcatgcattttaacagaaagtacaaatatgaatacattataatttgtaactgcatttaaaaattaaaatatttctctccaaatccaaaacaccacacaatctttatctgttctcatcttgttaccttagaaacatttgtcatatgctatcaggaaaatataggcaagacttactaatcagttattcatgatcaaagaaacatgattctccttaactgtgactttttgaatcatttat

SEQ ID NO: 547 - DNA, 427 bp, Homo sapiens
  Genbank Accession No. AA251837
tttaacatttaagacagcttttattaaatacaaaagcaaaataagctctaaggagtaaggtagggctacttaagggcgttttctgtggacagcggacacagcaccattaaggttagcttagatttgaacaaaccatgagcagacagctaactacatgttatgtttctcttagtagttttagggtctgcccagtaatcaagaaattttacttctccagaatacatgaacatgggaaccaaagaaatgtaaatatttcgaaaaagcactacacaataaaatgagacgcaatccttatgcaggtcaagatgttctccacatctacaatgtgcattaacaaaattaatgcagataagaccttcactccaaccccaaagatcttacatggttaatactattttccaaaatcagcagaacaagctgcagttac

SEQ ID NO: 548 - DNA, 272 bp, Homo sapiens
  Genbank Accession No. AA251845
aacaaaagaaaacattttattgcaatttgattaacaaggagacaggagcccagctcaaaatctgtcccattgtacttattttaaagagttattttagtagaaaaggtgtagggagtggattctgtgattagtaggtgattgatagaaagaaaaggaagggctggaaaatcctcgggcatgggcagttacctcttcatgcctcctcatgggtcccatgtgcaaactcagagggagttagtatgaaacatgcggtacaaatttaggctgtgtgt

SEQ ID NO: 549 - DNA, 376 bp, Homo sapiens
  Genbank Accession No. AA251909
tttttttttttttttttttttttttttaacagatactattttattatttacaaaatacatggtgatcataagagaacattttacaaattacaaatgggaaaagtacagggaaaagtagagacaaatgggttaaataacaaggtaaccatttgtaatgagtctgtttagaataaaatagttcttcacaaaagttagacaaggccatgagtaagtatatcactgtataaaaaatatcagtgacgtcaaaatatacctgtaccaaaaagtagaacagcaatggtagtgcatctaaatgtgtcctaaattaaattacagcacatacagtttcagtgttccacaatacaaccattgctctgaggcagcaatctgtgagact

SEQ ID NO: 550 - DNA, 397 bp, Homo sapiens
  Genbank Accession No. AA252060
ttttttttttttttactgatatctctttaatactttcatcattcaagtttgttcagaacattacaagaggcatgaaagaaaaaataattccatttttaaaactctgtccaaagtataacatatgaaaccatgccattatctcttaggaaacaaaagcattcaaaattaatttggtattaaagttcaagattcagactaacctcaaagtacggcatgtgcagtgtttaagtgcaagaagtattttcattccaattattttacagagatgctggagtgacgtgtgcaatttgaaatattcaaatcctttaaggtttctgaactaagtgtttaaatgaaaactgaaatgctgcatagtttcagtggctttcaatttcctgtttgatctcagaaatatatg

SEQ ID NO: 551 - DNA, 362 bp, Homo sapiens
  Genbank Accession No. AA252147
aagatctataaatatatttattataatataacaagaacttaacagtaaacatatactatgtacaataccattacagagaaccctgttttatatcattcacagaaatagccagttttgctccagtgtgatagatgaggagagaaacgaatttcaatgtcatctgtgttgagtctcgctgacaactagaacctcctttggcgtcagacgcacaccaatgctaacattagccctgccccaggcagttaggaatttgtgctccagtccttgggttcacacttgcaccctgtttgacataaatactttaaatgacatacaatgtatgtagttttgtgcttattactttttaaaataataaataatat

SEQ ID NO: 552 - DNA, 471 bp, Homo sapiens
  Genbank Accession No. AA252289
tcccatgtggttgatcctttattagacccattttacagattaggaaactgagatgagcagaggtgaagtcagccctgacaggtcacaggagcagcaggtggcagagcagaaattgggctcaagctagtgccaaatgtgccccattggccactgaccctaaagatgtgtgacccagaggccatgaaggagccacgttaacccatggccggtgtcatcctcttccggtttaggactagtggattttgggcactggagccacctctttggcaaacagcttgagggagaaatcaagggctggggcggcctgggtcagcatccccaatggagatgacgtctatgtgcggcccgcagaactcgggggaggttgtccagggtgatgcccccactggcttccacagccacactcgggaactgggccttcagcacggtggccgtggggtgcagctcctctggcttgaagttgtccagcag

SEQ ID NO: 553 - DNA, 507 bp, Homo sapiens
  Genbank Accession No. AA252355
  unsure (1)..(507): n = a or c or g or t
ttttttttttatgtctaaacatgtctttattttgcctccaatattgtacataaaattctaagttgatacttattttcctcagcactttgaagatacttttctactgtcttctggactttatggtgctgataagaaagaagtttgctgttggtttaacaatgattaccttgaaaattatgtgttttttctcactggtagaatactcacatttaagtagacatttgatgaatgtgcatatttattgataagactccacacaggactcctaattccatagattatgcggggaggatcatggtacaaacatccttctcccttatgaaggggcatggcagaaaatgaaggctattgtgactaaaaggaagctctgcgangattaacaacatataactataaccttgtctccaagggagatctaagagtgcccccacaagaatctgagagactgtaataggatatgaagagaacagctgaggaccctcatttttatttatttatttatattta

SEQ ID NO: 554 - DNA, 389 bp, Homo sapiens
  Genbank Accession No. AA252365
aaacttttgaaatcatgggttttagtttattatttttaatatatttctgaaaatgtataatatcaagactgtctgataatgcttttttaatactttccagttctgccaacattcctgtcatgcatccttaataacaatgctctcccagaaccgggatggggggcggtgaggtggggttggtgggggagtacgtttctgagctagttaaagtcactgaggagggcccatacctcaatgtgtgttgagttacaattagaaattagtcatggaaggacatgtctaccacagatatctttcctcacatttaaattattccatttcttcctacagtcctccttctatctttagttccattttaaataacccttcatcctacatacccatttatc

SEQ ID NO: 555 - DNA, 336 bp, Homo sapiens
  Genbank Accession No. AA252524
tattataaaattaaaatttattttcatttgttgttgtgtaaaactcacatgtggaagtgttccttgcacaggccgcagcatgcaatacagtttcacacttctgccagatattctatctcagaaagcaaattacctgcaaactaacactggatgacaagtgtcaccagaagtgctttggaaacatgattatgttatacaaagacttggcaaatccaacagcatacagtgcaactgaaaccttccccaaggatctgagaagtcttgccgatggaatccttggacatcaagagccaggcgaggagcagtttccgatctgctgagattctgctccgcctt

SEQ ID NO: 556 - DNA, 321 bp, Homo sapiens
  Genbank Accession No. AA252627
caaggaatatttaataaggtaggtaatatatgcttatttaacatggaattttatgtcactgctgctaaagcaaaacatcctgttcactgggtgaaagacctgctttatctgtgtacacttcagtgcaatttttaaaaaatactgtaattataatttcagaacttccgaatttcaacagatgccagtgttctctccttttttcacatgggaaaattcccttgaaactcatttgaagcttggacaaaaattccacagctgtattcttcaggatcactttgcagagtcttcaagactcagatacagaggaagcttcaattcaac

SEQ ID NO: 557 - DNA, 153 bp, Homo sapiens
  Genbank Accession No. AA252994
gggttatattaacagatgtcgaggaagctttcaggtgctggtagccatgagggtctggttttaaggatggcctttaaggaaaggccgtggcaggcgggctgagaggggcggctccagctcagccctgcccacagcacaggctcacagaagccg

SEQ ID NO: 558 - DNA, 169 bp, Homo sapiens
  Genbank Accession No. AA253011
agagaaagtaatttattgatataaaattaatggttaaaggtatacactgaggggtcttgcctactagctttattttgtagaactttacattatgtgaaatataaataaaagcatatttttaaaaatattatagttcttttttcatcatttattttcatatatgtacact

SEQ ID NO: 559 - DNA, 349 bp, Homo sapiens
  Genbank Accession No. AA253043
ttttttttagaagttcaattgtctttattatacagattcagagaagtaaaaaccagtaccaaactccaggtaaaatggtttgatctgatcgatttggctgcatactttcggtacgtataacattctaaacttaaaatagaaatttttatattacaaaacgtagaagtaaaattttaaaaagttaaagtactagcacatatatgtgttaggaaaatggtctctgtcaattgcccattttcccaattaaattaacctacgatttcctttttttaacagcttatttttttcataaaagttgtactttgagaagttactttctaattacgtcatgagaacacaacttgtaatt

SEQ ID NO: 560 - DNA, 406 bp, Homo sapiens
  Genbank Accession No. AA253129
atcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttt

SEQ ID NO: 561 - DNA, 385 bp, Homo sapiens
  Genbank Accession No. AA253216
ttttttttagagtcatagattttatttaattaaaatagattaaaaacagactgtgtaaaagaattagaattctcaataatttactattatttacattagcaaatgtcggtcgttagtagacactgagcagagaagcttgaagaacggggatcctctcctgtgggcaggggagccccagcttccctcgtgattcccgtcctttcaagttcattatggcagctctgtcaatgagcaccccagggtggtgtggccgcagcaccaggacccgcgctgaaggcccagagacctggcaggccgggagaaattcctttcctttgggaagaaccaccaacgctcagtccaagctcacacggttatctagtcggcaatgccttccctgccctgc

SEQ ID NO: 562 - DNA, 376 bp, Homo sapiens
  Genbank Accession No. AA253330
gttggaagcagccgcccacacgctcctaactctgctgcatggcagatgcctaggtggaaatagcaaaaacaaggcccaggctggggcaggggcagtagtgtgaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgt

SEQ ID NO: 563 - DNA, 454 bp, Homo sapiens
  Genbank Accession No. AA253369
tttttttttttttctcagagaattatttaataatagaattaccatacttttggcgcaaatgtgtccaacaccaatgtgacaagtacatatatcagaatcactctttcctcagagaatcacaccttcccttggctctgcatgtggatccaaatcaagcctgggtgtgtctgacaataccagggcacggtttgcttcccggccctccatctctactgtttggctacagcttgagttcactaggcatcggctcccctctcaggccagccagcaagttgttagctgccaacaaggacatggtgttgcgggttctgtgggtggcactgccaatgtggggcagaatcacacagttcttcagggtcaggagagggtggtttgtaggcagtggttctgggctcgtcacatccagtccagcagctgcaatcttaccactgggcaaggcctggtacaggtcgtc

SEQ ID NO: 564 - DNA, 403 bp, Homo sapiens
  Genbank Accession No. AA253410
tttaagtaatgcgtagtttttatttttaccatcattggagacaaaaaaaacaaaaacataaacatctgaagtgaaattataaagatggcttgatttctacattagagaatcccagcttgctcaatgaggaaaatgttcattttaaaagggccccttatagacatttgctctttgacgtcagcactccccatagagcacacccagatctaaatggatttccactaagaaagtctgtttaagaaacttcatcatgatgtttagcctgtcccagaattcattgttctcagggaatgacttgagagcaaagaaaaggaacattcagtgaggcaagagacagcatctcccagatgctgggaagttacacattttgtccttccttcctttgtcccaacagttattgagc

SEQ ID NO: 565 - DNA, 294 bp, Homo sapiens
  Genbank Accession No. AA253455
tttttagagcaatgtgcttccattttaatgaagcttgctatagaaaagccatttgatggttgtcaaaagcgtgaatgcctgtggtgtaacgtggaagtatgctgtggtgcaaagacgtagtcctttcttcctccagtatgcacgcggcacctgccacacctgctgcaaggacctggtcctgcccctaggccatctgctacgccaaggagacccaggtctttccagtttctaccaggccctttaatgctctatcctgtggcccaccgtgttgcagggactccagcagctgatgat

SEQ ID NO: 566 - DNA, 318 bp, Homo sapiens
  Genbank Accession No. AA253459
aaccagaggtggaatctttatttcacaagtttcaagatacagtacaaaacgattctgtacatctctctattaacaggatttgtttacacaattatattacacttcaccaacctttatactgcatttcattaaatacaaaatacatttacaaaaagagtctaccatggtgttccttcacaatgccagcttaaggtcttttaaaacttcctcttctacatatttatagtggttacatcttgattatatcaacattatgagttttatgagtttattttctaatcaaagagaatagtgtcagcctgtttctcaaaccaaata

SEQ ID NO: 567 - DNA, 278 bp, Homo sapiens
  Genbank Accession No. AA253473
cactggaagcctgaggggctgttgctgagcctcagccccagaaatacaaaaagtctttatttcacagaaattagggccatttccatagttatggggaaggacgtgtgagcaggatgggaggtgctcagctgactgtcctctccagaaggctcttctgagctgagcaggagaccccagggccacagccgagccccaacctagacacggtctgagctccaaccttggctggctatacttcaagggcgggtagggccggcatggggctggagggagtcagc

SEQ ID NO: 568 - DNA, 315 bp, Homo sapiens
  Genbank Accession No. AA255486
agtgactcagttttttattgaataaaatggcctacagcctgatgacagtaatatggcccttgggttttgaggaaaatatcatgttgtaggttggccaaaaaggagatagcagtccagctgaaatttgttttcttatactggctttaaggcagtgattagaaaaggcctaagaggtgggttctgtaagggattgctggaaggaaagtaggaatatggaaagtcatgagacatatactgtcatctcttcttgcttcctctcaagtcacatgcaaattcagggagagttagtatgaaacacacaatggaaatttgggc

SEQ ID NO: 569 - DNA, 404 bp, Homo sapiens
  Genbank Accession No. AA255546
cccatggtcacgcatccacacaaatgagtcttttggatgagaaaagtcacagcaacttgagttctcctaatgaacagatgactttttagccctgtttgtttcaatggggaaaacaatgacaaaaaaaacaaaccccaggcaggcacgacacttatgtaaaatgaacacagttagtacaaaaccagtaaggcatcactttgggaaggtcagcaccgaagaggtcaggcaaggctcgtccagacggggcttctgggagggagtgaccctcacccttattgagctgcgtcatgttggttctgaggaaagtgcaagtcttttgcagggtgaccgcatcaccccaccggaagctggggcggggacgctggaggtgttggtgtgtgttctaaacccttcaagacgagaag

SEQ ID NO: 570 - DNA, 396 bp, Homo sapiens
  Genbank Accession No. AA255566
tcacattaccgaaagccaagtaatgtggtgtgattactataattcctacaacaaaacttccacttagaatagttacatgttcccaaactatttttcttctgtctgccatgctggcttctgtatcccatggtccactgtaatcttttggtcttctttttttgcagtacagcagtcctcgtgctgctatccattgagtaggtaaaccaccaattcataggtggccatcataatggctgtgtttggaatctgtctcactagatgagttgtcagaccacgataaagagacccataaccttcttcttgaacaagcaaagatagagtctgaaaaaaagatctgtattttgttccctcttcacgtagtcttgttcttacaacttcatgtggatatgctatagt

SEQ ID NO: 571 - DNA, 302 bp, Homo sapiens
  Genbank Accession No. AA255624
tgcgccgctgcgggagcacaggaagtgaagagcttccgccgggagaccgcggctgcaggaacggaggcggaaggggccctgcggcgacgacgtcgtcgacgtggtgtggccgtgggagctgagcacggagaagactccctctctcggaagccggatcccgagccgggcaggatggatcaccaccagccggggactgggcgctaccaggtgcttcttaatgaagaggataactcagaatcatcgggggggttttttttttttacttcaaacccagcaccgcagattgtgcaggctgcgtcttc

SEQ ID NO: 572 - DNA, 371 bp, Homo sapiens
  Genbank Accession No. AA255878
tttttttttttttagcacaaagcattttaggtttatttaaataaaaattataatttatacaatactttttctttaaacaaacaaagttttcttaaaaaaatgttacaggagaatttttttcatcggttcttaatacagtacaatccttttgttgaacaaaagtcacactggcaatgattatttacagatccaaaatagactcaggcttcagacataaaaaatttaacattcatctagttcagtgattagtcacagaaattaaacatctgcccagatgtacacaatttggtaaaaactacagcttctctccacggggagcccagagcccgtgccgatccgcgctccgctcccgaggacttccagggaggggc

SEQ ID NO: 573 - DNA, 407 bp, Homo sapiens
  Genbank Accession No. AA255903
ctctctttttcaggggaggtgggtgcagataagggtgggcagggcactgtatagggaggaaaaaaatactgatattgatgggtcttgggattgcaataagtcagtttaccatttaagaggaaaatttaaatattcagtggaatgaggcactcaaagggttgaaatgcgatttttctttggtttccagggacctgtccctggtctctcactccaaggttaagttccaaaactatactttttggctcacagggctctctgtgatgctctggtgccagctgtgtactcttgagtggttaggcagcagttcacattagatgtgtaaaattaattaaacctaaatctctaggctcaagtccaggatgtccccagactagttcagaaactaagtgctctctcctccccttaaa

SEQ ID NO: 574 - DNA, 179 bp, Homo sapiens
  Genbank Accession No. AA256131
ttttttttttttttagctgctgaaacagacactcatttatttccccagaaggaggcagaatggggtccttggggagtctctgtcccagcccggacaggcagatctcacttccagaagagcacattccagaaaagcagccagcaggggtagaggcccagggacagcagtgggaagagcag

SEQ ID NO: 575 - DNA, 436 bp, Homo sapiens
  Genbank Accession No. AA256171
tttttttcgatttatcgttatttattatcaaaatcatgaccagtgtgtagacatacttgtgaaaatatacagcaacttggggcttataacacatgagcaaagatgacattaacacgtgcactgttcacatcttggggtctagaggtcaagaacaaagatcacagacaagacgttactaaacggacccctgcagtaggtcccgaattgcagaatcatccaattccagcatggtcagcacggagatattcacagaaagaaacccagcaaagtcctctctgagccgctagagtcaacaagcttttcatacacactatggagagcccacgccccacataacccttgagaacacagttccatgtcttggctaacacggctctcaccgctggcctcaacacccctgggccatgctccctctgctcttccatccccaccacaa

SEQ ID NO: 576 - DNA, 410 bp, Homo sapiens
  Genbank Accession No. AA256268
cccagcttttcaaaagtttattttaagtttggagactagacaaggtcatactggttttacatcctacgtgatataagtatatatacaaagaaaaaaacaacattggaatattacacagcttgaaggtttgcaaaggttatttgtgtcttagttatttctgcacttaatgacacatcagacgcattgagtatatttcataagttgttgactagcaaagatacaatcattagtaacccaagtcttcaaaattcacaccaaactttatgaagtcattcagaaagagaaagtcaatcctaaaattaaaattggcaactatgataaataccttcaaaaggatgtagatgtaatggagatgtttaaaagtttagtttcattaattgtaaaattagcatgttatatttactcaatat

SEQ ID NO: 577 - DNA, 237 bp, Homo sapiens
  Genbank Accession No. AA256273
cacattgtcagatcatttatttcagcgcagttacacccagcagaggggcacaggcttaaacgccggcatattagttttcccgcacgcgagccctgcatggcggtgggctggggagccggggcggtgcgattctgccacacgccacgctctactaggcccccttactcctaattaattgcctgctcaccagactgtgagaaaataattgccactataaattttccctccttctgcata

SEQ ID NO: 578 - DNA, 355 bp, Homo sapiens
  Genbank Accession No. AA256341
catcagcaatttcaattttatgttttctacttatttttatataagaatacaatgcaacaaaatattcatatattgcacaaacagtgatgtgcatacaaagatgctaacaacattggctggtaataggctttaccatgttacgatctaaatgcttgttcatcagagaatgtacaaaattctaagtttggcatccaaaagggggcttacagttattgaatatttttcccagccctattttaaatcaaattcaagtttgcctatgacaaagactgtctataagtaacagggcaagcataccaacatcaaaattattcttcttcttatctcacgtgcccctatttctcccaagtaagtg

SEQ ID NO: 579 - DNA, 379 bp, Homo sapiens
  Genbank Accession No. AA256367
tactatctagagtctagagctcacagtacagagttttgtgaaatacggtgcctatgagaattttcccatggtacacagaagccacagaggtgccctgaagcacagagccattgttggcatacacggtgctcaccctgggcttctcagacaaaacattctggatgcgaagtacttctgatcctggagggtcctcagggttatagttcagtagcttcataggattaggatggcatcctgccaaaatgtctcctgtggcaggatcgacagtcaggttatccactaaggtgcccaactgtatcaccttcagttgagttaaatcccagttatcatgtttttccattatgtgaatggtcctaactgctacatcagctacatagac

SEQ ID NO: 580 - DNA, 275 bp, Homo sapiens
  Genbank Accession No. AA256524
accataaacaaataaaattctttatttaaatttctcttgtggggaaaatatttttctttaaagcacacttaaaagtaatttgcatttacttcctgtaaagcatttccatttcacaattagcaaaactaaaaggctatgtctcttcatgcatttatttttgttagaaaaatgtcccatggtgctatcaaaccgattttaaccatcatcaagcttaactttgcctctgttgacaacatgactacaaacatgaatcaaaaaggagttaaggaatttta

SEQ ID NO: 581 - DNA, 368 bp, Homo sapiens
  Genbank Accession No. AA256606
gacaaattattttagtcctttagtacagtctgtttcctccttcacccccagaacaaaaatcgaacttctggttggacagcgtcagatgtcactgaggtgacccagcctgtttgcagttccaagtcttccgtgtaggcgtcactgctactggaactttgtagatgaggagcctgtatgatgatgtcctgaacatttctatcctttcctcacacagagggaagctacagaatgaaggggctggaaaacgttggtctggttccttttagagctgattccccattggatactgcctggaggccttggggatgaatgagaagttctgcagtttggatcagtagcagaagcaggtaacacatcagggaaccgga

SEQ ID NO: 582 - DNA, 318 bp, Homo sapiens
  Genbank Accession No. AA256642
gcaacatacaaaaactttaattatttttgcaaaaagaaagccaactattcgccttggaaataataatgaagtacaaatagctctgactctgcatttggacaaggatgaaccatgatagatatttagaaagggttttaaatcatgtgtatgttggctacagagtaaaaggaacagagaagactcaagctattgtcaggtgtgtatgtgtcatcagcacacactgggggaggagagtcctcactaagtgccacaacccctgatagctgtcagtctctcatgaagcaccatgatctggcatggactcccaaatgccacttg

SEQ ID NO: 583 - DNA, 332 bp, Homo sapiens
  Genbank Accession No. AA256666
gtgttcccataaaactttatttacaagagcagggtgccttggaagcagcccacggctgttagttcatagaccctgtctgctctgaagtagatgatgcctgagtgcccccgaggtgggttgctggtgcctgccttgctgctgtgagtgccaatggtgcccaccttgctgctgtgagtgccagtggtgcccaggacggccctgcagggatggcatcgagtccactctctgagccgtgcttgccggagtctgagtgggggcactgtttgtcacctccccatttctctgttcatgtgtttctcattcttcttccaccaccctggggactcagcaag

SEQ ID NO: 584 - DNA, 244 bp, Homo sapiens
  Genbank Accession No. AA256688
atcttgatattgtttattgtttacggttatgacacattatatatatacacacacacacatatgtatatagttacgtacacacacaccaatggcactgattttggtacacatcagaattacttaagagagtttgttaaaaatggagattctggagccccactctgtgagtctggacgataggtcctacatttttaaatgcccctgcctgcccccaaggtgtttttatacagatggtagactcact

SEQ ID NO: 585 - DNA, 347 bp, Homo sapiens
  Genbank Accession No. AA256990
gatttttatttgggtttattaaaaattttttcaaagtaatacatgcacaaggtaaaaaattaaatagtacagaaggacttaaaatgaaaaacacagtttcccatcccaccctttttaaatctaaatcccattccctagaggtaatgcttttaacaatatttattttagatcgtctggtaactttctaactttaaataatatgtttgagcaataatttcttgacttactgactttacaacatctttaataattccccattacaaaagataaggatttaacttacactatcgccactttcctttgtccatctctctccaaatgtctgatagttacatcactttttaata

SEQ ID NO: 586 - DNA, 156 bp, Homo sapiens
  Genbank Accession No. AA257057
gcgaaaaatatttttaaataaatttttttttcttacattctgatatacatatgtaacaaggtttatggcactgtaaccagaatcaaatcagaaaaaaaaaaaaaaaaggaaaaaggtgggaaggaaagtatttgatatattgttgaattcctttct

SEQ ID NO: 587 - DNA, 222 bp, Homo sapiens
  Genbank Accession No. AA258131
ttttttttttttttttttttttttttttttttttgacattttctcctaattttatttaaagccatcattatatattaaaagagcagaggtaattctgtcttctccggttgtgcagcacgatctgctccagctcgtcatgccagggcccggaaaacctccaccttctcccggtacagctggtggaactgcttggcaaggcagtggaaaggggcttcgaagttt

SEQ ID NO: 588 - DNA, 313 bp, Homo sapiens
  Genbank Accession No. AA258158
acaagatttaggtttgctcttctgcctctcactaactgtttgagcttgattacttttgtaaacttcaaatgcagacttctggttatcatcttcatggaaattcactttattcaaatgagaattcagagttccctgatattcttctgggtttttgtttaagtgtattcttggtttgaagccatgagttaaaaagtcacaagtatctgtgtatataaattgtaaaaggtattcaaacatgtcaggatgaaccttctctaccacaaagagatggcaccctgcagaatcttcatctttctggtaaatatctgtaaat

SEQ ID NO: 589 - DNA, 446 bp, Homo sapiens
  Genbank Accession No. AA258182
ttttaacgttaaatcgattttatttaaagccataaataaataagccaattaacgctcaagtctgagagggctgcagtctttttaacaataccatagtccaaaaagactaatacttattgctgattcagctcacaatattacccctttccagacaacagcacattcaaatgttcaagaaaacattttatgggcaccttttatgggcatttgagattcacagagcaatgggccatggcatgccctcaaggaacttacaatgtagctggagagacacaaaacatccaaaacagacatgaggggctggctctacctccacacctctatctgaacaaaaacgattactggcttaagtcctcgtgttgtaacgcatgagccacaggaatatcttagcaagtacgcactttatcaagtttcaatttgacatgtcaaaacaaaagtttttatgt

SEQ ID NO: 590 - DNA, 388 bp, Homo sapiens
  Genbank Accession No. AA258308
ccttgctgctgttcccgagtgccgactgatccatagtaaaaaaggacaagattaaaattttaggttttaatggtacaaagtgtgaagttttatagttttctaataattattcagtattatccctttcagagatgagggtaggataccacagacatcagtaactgacaagttataatatcaacacatgtaacatttgggtcattattttataaccctaaagggagcaactgcaggtgcagaagcagtgagtgaactagttttgtccagacaaggttttctgatgtgctattactttaaacaccacttttggacactaaagatttaaagtgataaagccactaactaactttattagactagtttttacataaataaccagatttctttg

SEQ ID NO: 591 - DNA, 444 bp, Homo sapiens
  Genbank Accession No. AA258323
taacattgctgaaaatttaatcactgatgggaaaaggaaagatgcaagagctctcccaaaatacaacagaaaagaagggagagatgaaaacaatgggggtgagaataccaaatgaaaagcaaagaaaaatccaacatttatagctattcccaaggaagagaaaagctaaattcaaacagattatttaaagatacagtcgttgaaaacgtatgttctaaaacaaaacaaaacaaaccctgtgaattgcagcctgaaaggaaagcatgtaccacgttctggataaatatgaaagcaaagaggccccatggaaacatatccatgcatagcccatgcatttgtgtcttctctcaccaaatagcaggagccccaaaatatgtatgtgtgggccataaacatgttagaactccagtgcattaagaaaactgcctttacaaaaggtggcag

SEQ ID NO: 592 - DNA, 431 bp, Homo sapiens
  Genbank Accession No. AA258350
  unsure (1)..(431): n = a or c or g or t
gcaattcttactttaacatcattttccagtgagctatgtgataggggctgaagcagcaagaatgaggtgtgtgagccctgtccccagcatcctggaggggcggtctatgctgagagccccaccagcaggaggactgggaggagcagggccaggacctgtagtgctcggggaggggtggtggctgaagcactggtgaagggctgggtcatggatttcctgttgcagaggtacccctcacagcaggagccctggaggtcgatggctgtccaggggctggtggtgccctcggtggtgcaggagggccggtgcnaggttctgatgtacacagggactgagaaattgccaactgtcattctgccattgccctggaagcaggcggtctggtcctggtgacactggactcgtcgggacctgccgatagcgcagtcatc

SEQ ID NO: 593 - DNA, 416 bp, Homo sapiens
  Genbank Accession No. AA258353
aatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactc

SEQ ID NO: 594 - DNA, 493 bp, Homo sapiens
  Genbank Accession No. AA258387
atatttattagagtagcatattaagttttgtagaaatcatatgtggatttacctatgacttatctattaattaaattcaagcaaaatatttgttataaaaaggagtcactgagtctcagagaattgagaatcattaggatcactggacagtgcctggaagaaaggacttcttatgcctccttcctcagcacccttagtgagtggactgagggcagcagatggatgagctaagagaggccaaaacagcaatggtggggggtgcggggcgtggggtggggagggcaaggaatactgacagcaggatggtcaggtcccaaggtgctctcccggatgctaagggcatcattcagcaggtgggcagcttccttatacttattctggttacgatacaccaaagcaaggatgttgagcatggtggcgacatcagggtggcacggcctgatgtgcgctccaggtcctctagtgcctgcttacagagtggcacggcacctcg

SEQ ID NO: 595 - DNA, 371 bp, Homo sapiens
  Genbank Accession No. AA258421
tttttgaggaggatactttcatttttattttatatcgtgaggtattgtttggattgttacaatgaacttgcatttcttttgtaatgaagaaaataatacagaggaaataacaacaactaaacctttggcctggattatcatcggctggaaattcatgttggatgcaagtttttattgataacaagttattttttgttttatatgcaaaaaatgttcattgaatgcctcctatttggctggcactgcctaggcactttcacaggtatttcatcctaatcctcacaacagccctatgaggtaatcattggtcccagtttacagaagccttgggtgggagattattgcttgatatacttctatttgccacacat

SEQ ID NO: 596 - DNA, 382 bp, Homo sapiens
  Genbank Accession No. AA258482
ttctctttgtccagttcctttattgggggcagggcaccaagaagaggccctccgctccccaaacccagaggcaaaaggggttggcacgctccctcccagcctagtccttgcgtcactgtccatgggcaattcctctgccctgcatcttcaggccatgtcaggtagaggtatccatctcagggacctcagtggacacttccgtgggcactgccagccgcctggggggcacataggatcccatacccgctgccctctccgcctcttcctgactgtagggctcgacgctcagctgcttcagccttttcttgtggtctttggatcggaagtgggtcttcaggttggtggaatcgatgaagtacctcgcgcaggccagacagcggtg

SEQ ID NO: 597 - DNA, 392 bp, Homo sapiens
  Genbank Accession No. AA258567
atcataccaaagtttattgattacatcaaacaaaaatttctgtaatggaaaaggcaagttgcagtcataaaagatggcattcacattcattttagaaagcaacaacgtagatgtaaaaaactgcttaagtgaaaaatgtaatattgcagtcccattttgcaagctgaaaaatgattttgtcaacacgcataaaatctgcacatttatatactgcatgttattaaaaaattccattactaaattattacgaattttgcaaagttaggcttacatttatactgttgctggtgtatgtgtaagtagatatggaatgaatgcatttcagtttagtaggtaacatcctcaaacaatggacagcggttgtgaaaattacaaagacattttgatagctc

SEQ ID NO: 598 - DNA, 272 bp, Homo sapiens
  Genbank Accession No. AA258613
gcgcacgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccgagttgagccttggccaggggtccggtgctgtcgcgggaaacctccagccttgttcttcaaaccactcagctcatgtgttttgcactgactagtact

SEQ ID NO: 599 - DNA, 157 bp, Homo sapiens
  Genbank Accession No. AA258614
aggaaaagttttttccatttaatactagactttcaaggattgagatgcaagctttgtatgcaattacatccaatgttaaaattggtaatacataatttacaaagattaacatcaaaacaatcatctatttagatatgcttttgtaaaaaggaaatat

SEQ ID NO: 600 - DNA, 250 bp, Homo sapiens
  Genbank Accession No. AA258813
ttttttatggttctcagataccactttaatcaggtttttcactatacagtgatgggggtagaagatggtgactgttttcaagcaaattcacgaggcacatgttcgtccctgccccaaagtgaacagtctgggcttcccagaacagaaaagtgctttccttcctgggggaatcccattcctgagctgacaagacagatttcagtaagaatgagcacaaaggatagggcaaaatagtgaagggagccaggtg

SEQ ID NO: 601 - DNA, 314 bp, Homo sapiens
  Genbank Accession No. AA258836
gtgtttctgggtcacttcctccatcactatttttatttttttccttaaactttatttttggcttttctgtctctgtagagacccctccttcttctgcttcctgttccccatcagaatcactatgcgaatctgatgatttggattcatctagggtgccaagtgaattttcattgaccttactagaaggcagatcactagtgtgtggaatgaaatcatcaggtttctcccatccgggatcccccggttcctgaataaaagtaatagggaaaaccatcttcacttaaaccttctacccaaacggtcttcactgctgt

SEQ ID NO: 602 - DNA, 318 bp, Homo sapiens
  Genbank Accession No. AA259064
tttttttttttttttttttttttttttttttttttacattcagcagtcactgcgcctgcagtcggcgacagtttaatgtgaggcaattaccgctacagacatcttgcttcatcttaaaaaaataaaaattttcaaagcatctcacaggccaaagagctaagcaggaccctcactcagacattcaagagtgtttccgaggaaaactcgaggaggaggcagcgtggaacatcttcccatggccacggcccggcacagagctcagatgcctgcgggaagcggcccctccacctgcggaagggaagacgatgcctgttggag

SEQ ID NO: 603 - DNA, 377 bp, Homo sapiens
  Genbank Accession No. AA261907
gcatttcaatagaactagctttatttacttatttatttatttaaacaaaagaaatggtttaaaagcaaatgcatatatgtaccaagggatggacatgacctggtacttacaaaggagctgctgtgtcataatggaaacagcatattaggagaaaaatagtatttcgtgtgctgtctgcttgagtaatcaatctggagatgcaagttaaccgaagtgcatctgccaagccatcagcgtgagaaaaaaaaaccaccagaagttgcctccagataacgatgtagtggcagcatgataactggcatcaactcacggtcttctcattttccccattttctataattttcctcttcttttcatctatttttttcttgaagatg

SEQ ID NO: 604 - DNA, 356 bp, Homo sapiens
  Genbank Accession No. AA261954
aatcttcaatttggcttttattttaaaatacatttagcatagaactgtcataggacagaaaataataaaacacaaatggaacattttcaaataccttttaagctagacataaaaatcaacaggatagcataggcccaaattatgggaaacggtccctaaaattcaattcattaaacatacattttgaaagtaaagctcttttcacattttccaacgtaccaatattttcctacatgccttggtttccttttaactaataagtaaagggtaaatttagttgctttacttaaaattaccagcttcagttttggtaaaaattaccatgcccctaaattctcaatcagaattataaaaat

SEQ ID NO: 605 - DNA, 298 bp, Homo sapiens
  Genbank Accession No. AA262030
ttaatttttcaaaccatcaacattttatttaataaaagcaactgagacattttctaaagtatacggtatatttgatataaaaattcttcaaaatatgtactatagaaattcttcaaaatatgtactaaaaatacaaagtttgtgaatctaaggtacagaaaacactttatacttcagtcacccaaaacaacagcttgtggtctcctccaattacacacagagggagagttcgatgccaggacagtccagatccaacggctacagaacccatgaggatgggctgagggtgtcctaaatg

SEQ ID NO: 606 - DNA, 407 bp, Homo sapiens
  Genbank Accession No. AA262033
tttttttttttttttttttttttttttttttcaaagccgcgcaatcatctgcattttatttgcacctcatttgcaagttgttaatttgcaactctgctccttccactccagcttccttctctctcatctcccctcaaattccccagtggcctgggcaaaaaatatcttggtctttgccaaggtagactcagccttgtcagcaggcctgtcctgtgttctcaggggaggcctttacccaaggccacaacaacagcaggaatcccgagtaagacaccaccttgacggcagggaaggctggatcttttcacagggcagaactgatttgatgaggtgaacagtaaggtgagcagaggtgggaaaggccagtgggtgaatgcaggaacagcaccaggagctagagcccaact

SEQ ID NO: 607 - DNA, 221 bp, Homo sapiens
  Genbank Accession No. AA262349
taagaagttatatttttatttcaaattatgtaacaactggggacacaatcaatacatttcactggtatcatgaggaagagtgtcacactaaaatggagtccaagcttttatcgatgcaattgctttataatataaaagaaaaaatcaaacaaactagcatattagaaccacttttggtaatttgtaaggagctgaagactgctgatatcacacatcccatg

SEQ ID NO: 608 - DNA, 337 bp, Homo sapiens
  Genbank Accession No. AA262477
tttttttaaaattaatcaaccaacacccattctatttaaggttccaaaaggaagtagctggacccggctgcagacacactcccaccttgcttctgtcccaaaagtacatcccctacgtgtggttctccttaaacaattttaatgtctgggttggggaagcaggtagagcgcgtagaggcagctgctagaggctggttgctgactccaggccgcgttccaggaaatatcggtgggaagaacggggacgggcttgggacccttcattgaggaagtaggatgtgatcttcctgagtccctcctgattctcggatgctgagtcctcccatataacatcttc

SEQ ID NO: 609 - DNA, 414 bp, Homo sapiens
  Genbank Accession No. AA262766
ttttgtcttttgcttaccttcttgcttaatggaattgttatggctaagcacatagaaggccaaaaaaggagttttccaaacccagcaaatcaagtgcttggattctgaactgccaaaagaaaactgcacttcccctcttaagtaaaacgaaatgagtttcttaggtaaatgtattcatcagcccagataaaaaaaaaaccagttatgtgagcgttagtcactgctcatttccaggaagatcaaacaaaataccagcccagccagactcacatgtgtgtatatatatataaagcaaagagccacacccacaagccagcagctgggtgaaatatcagctgtccacgccgtggtatgccaattcggggaaattactccttggaaaaactggaagaatctacttgctggaaaaaatag

SEQ ID NO: 610 - DNA, 312 bp, Homo sapiens
  Genbank Accession No. AA262887
gttttttacaaataaagtgttttatttacaggagttgtctctccaggtcccagctccctgccacccccaccccagccccagggagaagagggcggatccagaggagctggcagaggctgggcaggtcctgagtgggccaggctaggccaagagagaaggcacgaggccctgggcgccccagtcccagggcagaggccaggcctgcctggagaaggcagcacggggtcagctctcaggggtcaggctgggttccacgccgccgcagctctgctcataagacggtggggcctcataaggggtagccccaagaac

SEQ ID NO: 611 - DNA, 290 bp, Homo sapiens
  Genbank Accession No. AA262943
ttttttttttgccaagtattccatttattaacaaaataagtcttaccaagggagagctctgttcgtcccaaacaggccccgcagcccccgcgctgccgcatcagaccagaaggagggaggagtggggagaagaccccagtcgctggggggtccactctgggggctctgcgggccaggcctaggatagggcgggggctgctgtgatccgagagctccctgacgccccaaccttccccgaacgcagctaacgagctcgtgacatccgctgacatcgccaccggtctgctttg

SEQ ID NO: 612 - DNA, 146 bp, Homo sapiens
  Genbank Accession No. AA262957
ttttgtgatttcattttaatcagaaacacaccaaataggcatcatggcagcagatctggctgctagtgttttaaatacagatggattgttaacatctttattattcataattgtctgtcaatgttctctggatgatcaagaaactc

SEQ ID NO: 613 - DNA, 281 bp, Homo sapiens
  Genbank Accession No. AA262969
tcagggctggaagttgatttttaatgataaagtacaatgaagggagggcagaggggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgccttgcagcttagccaagatatattcaaaaccctt

SEQ ID NO: 614 - DNA, 373 bp, Homo sapiens
  Genbank Accession No. AA263032
gtcgactcctgtgaggtatggtgctgggtgcagatgcagtgtggctctggatagcaccttatggacagttgtgtccccaaggatggatgagaatagctactgaagtcctaaagagcaagcctaacttaagccatttgcacaaaggcattagacaaaaagctggaagttgaaatggtggagtccacttgcctggaccagcttaatggttcttctcctggtaacggttttatccatggatgactttcttgggtaaggcaataaggcagttcctgtcataccttttaaaggtatggagagtcggctttactacactgtgtggagcaagttttaaagaagcaaaggcttagaattcatgattgaggaatgcaggcag

SEQ ID NO: 615 - DNA, 394 bp, Homo sapiens
  Genbank Accession No. AA263044
agacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaaaaaaaaaaaaaaccttgggggttcttttggggccgcccggggcccattggtttttcccccggggggggccc

SEQ ID NO: 616 - DNA, 384 bp, Homo sapiens
  Genbank Accession No. AA278670
gaaaaatatagacatttatgataaaatcaattggtttgataagaaagcaattatttaaaaagtttaatacaaatacatgttaagtgtacaaattaggattcttttgggcaaacaagttgttatctaaagaagaagcaaaacctccttaacagttgtaataaaacctatgcctgaaaagttggtggctattacacggaaatatttatattgtgttcttctactcccaataactacttttaaagaatcaggataacttaaatagaatatcaaaatataaattataaataattataaaaatatatctgtacaagatttttattgaagacacatcagtgcataaatgcctaaatatgaggctataaatacagcaaaatattcaagaac

SEQ ID NO: 617 - DNA, 179 bp, Homo sapiens
  Genbank Accession No. AA278768
ctggctacaaattttattccgttacaaatagcaccgagcccttggcgtgcccctgtggagagggatccccctcctggacccccacctcctcccctgagctacccatgtagtgtctgggagctggcacacggcccagggtccctctggaagctgggccaggccaaggggttaggcccagg

SEQ ID NO: 618 - DNA, 425 bp, Homo sapiens
  Genbank Accession No. AA278817
tttttttttttttttttttttttttttttttcaccatcagtatcatttttattgcaaatcagttaacaaaaaagatgaaaaaaatacatcatctacagttcctcatgtagatcacttttaaagtctttttctgtaaactacactctattttataaaacacagtaaaaatcaacatcttgggacgcatctggtcatgccccctggggatggcaccacgcggcccccgtagagccgggggaggctgccctgaggagtgcaggcggcacggcagcggagttcccccagtgcatgggcggctaaggctccccgagctgagccgagtctgacgtccctcactggcatgacacacaacagactcattcattaagattttttaaacaaaatccacctttaaaaacatatttacagacattttttctgccata

SEQ ID NO: 619 - DNA, 379 bp, Homo sapiens
  Genbank Accession No. AA278824
catatactttaggaaatgtctgttctccaattaaaaaatgctataatctccattctaaaaattcactgagataaactgaaatctatcaatttaaccagctgtgatccaaaagtgtaattaacggcagtcagtgaaacaggtatgggatctctttaaaagtgtaaaagtgggttgagaccttatatttttacatttcagactttagattttaaaaaatcttttggacagtgcctgatttgtatgtataccacagtgttaactacgccctagcatcttgcagtgtgggacacacaattagcctatgtccccagtactagtatttacctgggaaatactccatggatgcacacattcacacaggcacatgcagagttgtctt

SEQ ID NO: 620 - DNA, 363 bp, Homo sapiens
  Genbank Accession No. AA278838
tttttttacacaattctctagtttatttgtccgaaataaatacaacctgagaacatccatttcaatgtccccaaacactatttatcccctgaaaaagcagcttaaaatatgggtgcacattttgcagcttatgttctttggttaggctctgaagggtgtttgttctgggctgggctaggctgggcctagcctgtagagacacacctaagttccgttctctgtttggaggctgcacccagcctgagtccccaccagtcccctccaagagccctgatgctgcttccggagcacctgtcttcattgcctctcccttctgcagcctgaaaggagggatgttcaggactctgcagctctgtgtccagc

SEQ ID NO: 621 - DNA, 381 bp, Homo sapiens
  Genbank Accession No. AA278853
tcacgctgaatgataagacttttaatttggtagacttaataggcaaagtccctatgagtaggcaaatctgcatgttgagttttattccaggttcagttttaggttcactgtctctctctttgatgaacactgcacaaagttatttgtattacagctccttaaagaaagagtacaaattgtttacgactagttttttcatatacacgaaaaagcacaattataatttctgtcccactcagaaattaatggcaaacccatagtaacctaataaagctattttaacatgtgctaaataattcttttatctatactgttgtattgatcaaattatttatatgctctttaaaaatcttttatgaattgaaagctataactctctct

SEQ ID NO: 622 - DNA, 201 bp, Homo sapiens
  Genbank Accession No. AA279112
cttttacctttacatatttattgttaagtaccaagcaaagtgtaacaattagaagaactcattacaaactaccaaaatgtattcatttggtgaaattattcaagtcacaaatgcttagtaaataaatgtacttcaaaatacgtgaagtgtaaaacaagtatgaaaacagtgatcttaaacaatgattcctttcacaaaaac

SEQ ID NO: 623 - DNA, 132 bp, Homo sapiens
  Genbank Accession No. AA279158
ccaaactatttttatttagcatatggtattgttaaacaggtatagtattcttaacacacaccttccaccacattttgttagagggcactttatattttatcaaaaattgtgcattttaatagattgtagctc

SEQ ID NO: 624 - DNA, 355 bp, Homo sapiens
  Genbank Accession No. AA279177
ttttttttacttttacttaaaagataaaacaactttattatgacatcaccattatatacagctgtgcttttcacatcaagttggcttagttcttggaggaaagtcttagtgactaaaattgtacacagatcacaggacaagagaactagtctaacaaattcaataagaaatcaggacaactgtagactatataaaaactgtcttagaaaattatttacaactttatcatagtgtaaatactctaaatgtaaaataaatctatggattttatacaaaaataaagtacaaatgtaagttaaatgccgaataaaacattttcaccttttccagtggatgctattactaagactataat

SEQ ID NO: 625 - DNA, 377 bp, Homo sapiens
  Genbank Accession No. AA279341
ttttttttttttttttttttttttttttttttttttttttttttttttgcacaaaacaaaaatttattgggagaaagatggctgatgggaggcaagatctggattcaggaatcctcaattttagctctcgctctgtcaccaaaaccctccgtccctcccagagcctcgaggagtttccccttgtgtaaaccggtatcgcgtcccttccagctctgacatcctgcggttctagaatacccattgattgaaagagctgtggccaaacaggaaggacagagcaagagccgctgacaaaggattctgccaagacagaatcccaaggtcacaggagagaggcttggggcagtgaaagccctctcgggtctttggctttggaa

SEQ ID NO: 626 - DNA, 311 bp, Homo sapiens
  Genbank Accession No. AA279418
tcctttatacttctgtttatttttcctgcttatgaaaacagccaacaattgcctttcaagggaagggaaggtaatgctgggaaaggtcctcaggagccctgagccaagttctcaagagagaagtgaggcagctggggatctgggaggccagagtccgggccagggcctcagcatcctagaaccagggctgcctcccgaagagcagttcagagggcgtgactccatacgggcagggcggctccacacaggcctggaacacccttctcctcagcccagggagctcatcagggtctgggcctgcttcagttctg

SEQ ID NO: 627 - DNA, 480 bp, Homo sapiens
  Genbank Accession No. AA279533
atatttcatatttgtgtatatttattttagataactgaaacttcacagaatttaacagcaaataaagtttaaaaaatttagttctgtacattagttccaactatccctattttacaatctataaggctcatgtcatagttcagcaccaaaaagatctacacaaaactgtttaaccaatcttcttatctatcctgtgtgatagttttgtttgttgttgttttttaaggtaaaagtcctacttcagaccttgaagtggaatacttctagtcagactaggtaaaaacttgggtcataccttattttcattgaacagataccaaaaaaaaaaaaaaaaggaaaaggaaaagagctgtgttacaccatgaatttaggttgtcagcctctatgttgaatttataacactgaagcatcagaaatagcctaataatgccctgcccctattcttcccttccattttaaatttttaaaaaagtaaccaga

SEQ ID NO: 628 - DNA, 401 bp, Homo sapiens
  Genbank Accession No. AA279550
attttttttaaaagatgcaaaactttttaattaaaaaaaaaaccaacccagcaaaatcttataaaaacgaaccaggtagcccaaaaatgcccacctgtctctctatgtacagtaatacaatatttgtcagtcactatatacaatattataaaaaatgccgcagacagtacaaattaaggcccttatttctcacaaggcatcacaagcctcgatcctctagtgtacgacccggtgggagagaagatgccacttaaattattgcaccattttgaaaaacaaaactcggtcaaggaggatcgtggtcttttcccaccgggccttcagtcacagacgggggctggggtggtggcgtcgtcgtcgtcgtcatcgagggagacctctgtagccacgctgtgcccggc

SEQ ID NO: 629 - DNA, 474 bp, Homo sapiens
  Genbank Accession No. AA279667
gcttaacctttttttcttttctgcgttttttatggtggccagagtgtcttgctgtactaaggtctgaataatatccattataggaccatgatctggatctctgagacaagcttctttcatcccatcggcttgaacaggggtcacttaacttatctcctttactccatttttctccactaggtggtctatatgctcttaatctctgcatttcctctttccagtgaggaggagtttcactgctgtcatcatcatctgactcagaacaggatcttgatcttggaggtgtgtgatagcgaattgtgccccttcctttaatcttccgtccagactttgatacagatggtttctgatcacttacaatgggtgcaacatcaggaatcttcggttcaggttctgcagtaacaacaggcatatctcttctcagtaaaaatcggttctcaggcactggaggaatctcttctgggcgggacacag

SEQ ID NO: 630 - DNA, 392 bp, Homo sapiens
  Genbank Accession No. AA279676
ctgttagagacattttatttagaggcaagaaatggttaataagatgagacccttgggtctaggagcgttttgctcttttgttttcttccgttagagtgacagattttttgctgttggtgaaggcccttgaagactgtagtttaaattcaactggaaagtggtcgctgacatccagggcctccttttcagtcagcttgtaagctttctggaagtcaaaaacactgtttgacttgggaacaacagaactgacgatttcttgtcctctaagcacaatcctgtcatatgcacagttggtgctcttcttcaccgtggtgtcctcttggtccccgatcagccaaacaaacctggggtcagtcctcaagcggatgttcttccaggccttcttggggacg

SEQ ID NO: 631 - DNA, 264 bp, Homo sapiens
  Genbank Accession No. AA279802
tttttttttttttttttttttttttttttttttttttttttttttttttccacccatggtggctttattcagtcacgtccccacgcccacggctccctccaccaggcagacagaggggaggccaccccactgcaaagggtcccagccagtgggcaccaacctcaggaagacgtggtccccacctggagcttccctcggctgccctggcccttgagcccgtcctgaggatttgtgctttgactctgacagggagcagcaggaagc

SEQ ID NO: 632 - DNA, 326 bp, Homo sapiens
  Genbank Accession No. AA279840
cgtgtgtcccagccccactttattttcgaatttaaaactcagggtcaattcctggggttcccaggcaaccctccctcgagcccactcactaggggccagccctagatcttgaaggccaaggtgagtccatcgcccaggggcaggaggctgatgtagaccctgacgtcccgccggatgcgttcgtttaggtttcgcacacactcggccgccacgtcccctttcggaggttgcagcaccttcccgcgccacaggactctgaggacggcgaggatgcctccgggtcgcagcagctgcaggcagcgctcgtagtaaggcggagcagttct

SEQ ID NO: 633 - DNA, 409 bp, Homo sapiens
  Genbank Accession No. AA279916
aagagagtctcactctgttgccttgtggagcgcagtgatgtgatcacagctcactgtaacctcaaaatcttgggctcaagcaatcctccaacctcaacctcctgagtagttgggactacaggcgcacaccactacaccaagctaattttgtctatgttgcccaggttggtctcgaactcctggccaatcctctggccttggcttccaaagtgctggggattataggtgtgaccaccatgccagacctaaaccctaatttctttatgttttgtaaataagagtgccacttcttactagtgacaatggtatataatctttataactagattttattattttctattgttttgaagacagagtgatttcccatcatttttggggtttaatgttcttatcttaatctgcatta

SEQ ID NO: 634 - DNA, 458 bp, Homo sapiens
  Genbank Accession No. AA279937
tttttttttttttttttccatgcagtcaatctttattatagcagtattcgcatattcacatcaagtacatagaactttttttgccttttatataatacagtttttaaataactttacacagaaataaatttcttcaatctgaatttcagctatctttttttattctccatgctttctatccaaactgaacaatattttctgttatacaaatttacatgagaaaaactccaaagtacaaatgaagggacctgagcaggaaagagaaccaaagtatcaggaagtgggtatgggggagaattaaaaaaaataataaaagattcaagcaaacattgagaataggggaaaagagggagacatcatccatttgactgaaaataaatgtcttttttatgaattgaaaaataagctttaaaaatagttactccattgtaatttttgcaaagcaggtatagagaggt

SEQ ID NO: 635 - DNA, 453 bp, Homo sapiens
  Genbank Accession No. AA279943
gaattttcaattttacatttaattataagaccacaataaaaagttgaacatgcgcatatctatgcatttcacagaagattagtaaaactgatggcaacttcagaattatttcatgaagggtacaaacagtctttaccacaattttcccatggtcttatccttcaaaataaaattccacacactatcaaactaaatcaagatttgctagtggataaaattaccataaatataccgtactctctctgaaacagctacaaacatcttgtttttgcaaaatatacaatgtttctcaatctttctgtccttatctcaatttgcaaaaatattttgaaacaatctcctttaaatgttattcttgttaatgagggcaaatcttttaaaatccacatgctagatcttgaaaacgcttgagaagaaaataaactgtgaaaggagtggttatttaaatacttc

SEQ ID NO: 636 - DNA, 321 bp, Homo sapiens
  Genbank Accession No. AA280130
cttcaattgatgcaactcagtaatttttattgcaactggaagacaatacatcacagaaactttatggtaggtctggggaaaagtgttatttacaataaatgatgaaatagtttgtctttggcaatatgattacatacgaagaatgcaaaatgcaggtatggatgccttccaagcaacaccaagtccctagagttcggctgatcgcgcctgcctccacactgtttctttaggtttacatgaacataacagaacatcacgttctttctcctttatggttctccctttctattcatgatattggcagtttcatacagaaaatac

SEQ ID NO: 637 - DNA, 307 bp, Homo sapiens
  Genbank Accession No. AA280283
attaataattctctatttattaaaaagggtcctacagctttacagccacagcaccggacacggccctggacagcgacggcgagcccggccaggggccgctttgcaacttcaatgccaagctcacgtctggctgcgaccgtggcaggctgtggcatccccgacagcggccggtggcggaggtatgggggcgggtggcaccgctcactcgagattcacagaacatggcaagcccgcctgactggcatggcagtgaatcgtcctgtacagcttcatttcaagaaaacagttaacagtaggagttcaaagt

SEQ ID NO: 638 - DNA, 219 bp, Homo sapiens
  Genbank Accession No. AA280413
ggattgagaataactttacttgttttttgggaggaggttaatgggtgggaggggtgagaggggagatctgatttacatacggacttgagactcccaaggcagtaccccgggtcgtcctctgcaaggttgccccggtggggtctgacgcccagctggcgtcctgggagcctggggtggagtccatggagggagagcgaacggggaatgttggagggggcc

SEQ ID NO: 639 - DNA, 394 bp, Homo sapiens
  Genbank Accession No. AA280734
tttttttttttttttatcgtagagtacgttctgcattttatttctgcaggcaacacttttgctcaccagcaagaacacagcccgaggaagggacccaataacctttcaaaatgcaaactgctgcctgcggtgagggcccagggtcctccacggagaggacaggcatcttcctttcccaccaggaaggagtcagcctggagcctctgctatgtgcaaggcggtgtgcaagcacggctgcggctctttgctgtctcttctttctctttggggctgggctgggtgtgcgttctggtgctgatgctttggcctgtgaggctgagctagagaagtgtagatgttagatgtgccagtaccatcctgcgcctcccaagcatgcccccactcactcacgtcg

SEQ ID NO: 640 - DNA, 445 bp, Homo sapiens
  Genbank Accession No. AA280791
gtttctcccaaataaaatcagtttattgtttaattgcaccccaaagcaagttctctcagtacaaagtaactactacgcacacacaaaatgcttgttaatgtaataatttccctggctcatccaacgtgcaatgccacgacttcaaagacaatttggggcaagtgtacatgaaatgagaaaacagctctccaagtttcaaatcctcctcttacattatttataggacactgaggtcatatttacttcttggttaagatgttgcactgtcatttcattatcagtctacctcacaatgtacattaccagatgccaatttgaggaactacagagataaaactttagtactttcttaatgggctgaataaattaattacaattaagtttgctttacatcctgttgaggacctctttgcagccccaggacctaacaatatctggcaggctc

SEQ ID NO: 641 - DNA, 372 bp, Homo sapiens
  Genbank Accession No. AA280840
ttttctttttttttttcttttttttttttttttggtttcatttttcttttatttttttaaaaaagcccctaaattctatggcttcaagggagcatcagagaaacgtaaatgccatttctgtacacttggtaaagcaaaaactagactcacagccaccgccctgggacggcccaagctgctccactctgcccggcagcctccagggcaccccactgggaaccgcccgccagtccagggccgcccccaggcccctgcaatatacctgcagggctgggccgtggggctttaaggcgttttgtctccggctgcttgccggatgtcggagcagagaggcaggaagctccgtgcccacgcgccccacgcggcagggct

SEQ ID NO: 642 - DNA, 333 bp, Homo sapiens
  Genbank Accession No. AA280928
atttttgtataatggtttatttaatacagtatacattatctttcatatactttgttacaatgttaaaaaaacttcatttttcataatataggaaataaagttggaaacaactctggtgggaatacttcagatagagcaagaaagcattcacagcaaggcctataatcagtaagatgtgtgaaaagttgggtagccacaggaggtgttcattaaggatatgattccatttatatagctatttctattgcataaccaggacagttttattgttttgaggtcaatgttcttttaaaatttgattttctgtaagaagaggctttttggcccagaaag

SEQ ID NO: 643 - DNA, 383 bp, Homo sapiens
  Genbank Accession No. AA281214
catcgtttccatacagttttatttgcaatttgttggaaccatggagaacaatcggcagatacacatgttgcttctgggaacagcattcaactccagatgctttttctgctaaggagcagggccacaggtggctcaacacccagtgctgtgctgcgcggagggctgtactgaaggttctgaaggcctggtgagtccccctcacggccagaaggagagacccggcttcggcttcatggccggcctcccgcaggtgtctgcccagctcctctgcatcccagcgcccttgctggaggctagccaagaggtggtcaacaatacgtggatagaagggagtggagacacacttcaccagcagcttggcatccaggagcagggaaagaagt

SEQ ID NO: 644 - DNA, 403 bp, Homo sapiens
  Genbank Accession No. AA281440
atgttcaatttttggtttattaaaacaaaactacattttctgtgtttcttgcaatacactaacaagcataaaaatcaatcagcatttccaagtatgttttgctcacaaaatcgcagttatttcacagtaccttatagtaattcttttcacgagtcttaacatttctttgtacaacaggcaaatagtttaataccttccatcaagacatttcagagctctagacgtttagaaataaggtcaagaatctctttcaaatgcaatcattagtttgtattaaactaaaatgccagacggcaagtctcaggtttctaaaatagttttaaaaaacaggtttacagcccatagtaagtcttagaaacctcaacgataggtcctgtcatgtctaaacactacaactatctgt

SEQ ID NO: 645 - DNA, 392 bp, Homo sapiens
  Genbank Accession No. AA281545
tttttttttttgagcttttgtcactttattgttaaccaatgaatattatccaaaattagagatgtaattgtaacttaattgtacaacacaaaattatgctaatggtaaaagcctactgggatttaccaaatactcattagtgtatttttacattgactatatgaacatgtgctcgcgactgctaataagttataattggtttaatctctaagaaatccatattgcaaatggttcttgtttagaaaaattcacacagccttaaaaatggattaaatccattttaatcctaatctacaaatagatcataaacagcaaaatataactgataatttttcaatactgtatcaaactgatgtagctatggtagtgcacataattcaaaatgaggaaaa

SEQ ID NO: 646 - DNA, 365 bp, Homo sapiens
  Genbank Accession No. AA281591
tttttttaattattccttcatattcaaacttcacaaacagtgtgaacttgtacaatacctcggaaagtgaaacttacaaaaaaagtgctggtaacatttaaaaaaaaaacaacaaaaaccccaaaaaaacaaacatcattcttagcaacatcaattactcttccacacaaaacagaaaccttgtaaaatttattttcgtatttttaaggcgtaatacttccgtataaagtatatgcaagagataaaacttcacagtattccaaaatgtcacaataataataataatataatagtataatgaagcgctacagttaatttttctttttttgaatgttttttttcctgtttaaataacaaatacaagt

SEQ ID NO: 647 - DNA, 369 bp, Homo sapiens
  Genbank Accession No. AA281599
gaaaaggcatacaaatttattaaggtacagggctgaggaccacagaatattaccccaaccccccagtggttacagaagcttatatactctttctcagaggcaaaagaggagatgggtaatgtagacaattctttgaggaacagtaaatgattattagagagaaggaatggaccaaggagacagaaattaacttgtaaatgattctctttggaatctgaatgagatcaagaggccagctttagcttgtggaaaagtccatctaggtatggttgcattctcgtcttcttttctgcagtagataatgaggtaaccgaaggcaattgtgcttcttttgataagaagctttcttggtcatatcaggaaattcca

SEQ ID NO: 648 - DNA, 319 bp, Homo sapiens
  Genbank Accession No. AA281677
agaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagatta

SEQ ID NO: 649 - DNA, 374 bp, Homo sapiens
  Genbank Accession No. AA281770
agctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaact

SEQ ID NO: 650 - DNA, 305 bp, Homo sapiens
  Genbank Accession No. AA281796
agtattaaacagttttgtattattcaactgagtctccagtctttattgtcccatctgttcccctcactgcagcaggaaccagccccatctccactcccttccgcctagacctgccagagcaggaacctcctcaccccaccctggggccctgcctgagtcattctccgtcccccttcccccaccccagcactggggtccgggagacagtcccagccgggctgagggagggaaatggcagccacagcctcccagtccctccactctgccgtccagactcagtcttccagggccagaagggaagcagg

SEQ ID NO: 651 - DNA, 263 bp, Homo sapiens
  Genbank Accession No. AA281930
ctgcaaaagtttggaagaaaggggagtagctgcggtggggcgatggggccgagaggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaagcagtcgagaatcaacccaaaaaagattgtcacagttttggtttcggaattatgc

SEQ ID NO: 652 - DNA, 327 bp, Homo sapiens
  Genbank Accession No. AA282061
tttggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctgggattacaggcgtgacgactgggtccggcctgctttttttttttttttttttttttttttggagacgga

SEQ ID NO: 653 - DNA, 411 bp, Homo sapiens
  Genbank Accession No. AA282089
acaacattcattatatttgatagatacagaagagtacagtcactcataatcccaccatttaaaaaaatcaacagtgttaacagtgggtgggtatgtttccagacctctcaattcactcatatgtacagacaggattgacggggggaatcctaaactttttattctaacaagttttatttatttattttcttttttgacatggagtctcgctctgtcgcccaggctgatgttatatcacccacctaaacgtttattaaatagggaaataagtttctattttgttttagccaccctgttatggcagctaaacccatatcttcaataaatttgtttggagaagcagggcaagtaatgacaataaacaagctcccaaacaaaagcattttatatagttaaaactgcttgtaagag

SEQ ID NO: 654 - DNA, 304 bp, Homo sapiens
  Genbank Accession No. AA282149
ttttttttttttttttgacaacaaacagtcaaagtgcattttattgccaacagaacacttcaggaggaaatgctaacacaaagccaaggcgctggtgctggctcatttttgctcctcctgaccttggccagtatttggtagcctttccagagcacagggtgaaaggctaaagggctagggctggggtggggggagcaggagggcatggcagctgctggctctgtcctcccagcctggtcccacccctcctgccgctctccttgggctcaagggacacacattcgttcaaatctgacgggcaaag

SEQ ID NO: 655 - DNA, 295 bp, Homo sapiens
  Genbank Accession No. AA282179
tggcagttaattttctttgataatttttattatatacatatcagtactcacaatacgttgcttatttaagatggctgtttataagtataaagcagtttgagcaacactgattgtgcattattgtacttcagatgaaaaatccttacatgcggaatcaatgtcttttaaaatttcagataaagaattttcatttgaggagacatacaattgtaagtgctcattttttgtcaattttaagacaccattatgtgtaagaaggattaattttaccataaaattacaaacaccctccatg

SEQ ID NO: 656 - DNA, 350 bp, Homo sapiens
  Genbank Accession No. AA282238
  unsure (1)..(350): n = a or c or g or t
gccgagcccaccccgccctctcccgcccgggtccgcgcaccgttccgctgcagaaagcgcaggccatcccggtatccctgcttgcacatctctcgcagcaccaggggctccggcgggaagagggccttggagaggcggtagaggttgcgcaggttgaactggatgctggtgttggtgacccgcagctcgtggatgttggtggagctgtcctgcggacnagatgtcactctcgcccgagaagggggacactgtgatggtgttcttaagctcatagagtggcaggttgtctgaaatgccaccatccacgtagcgcttccacgggacacacagacaggaccgtatgtgagggc

SEQ ID NO: 657 - DNA, 375 bp, Homo sapiens
  Genbank Accession No. AA282247
tttttttttttttttttacttttagttcacattttttaatgtttaaaaactatgttaacagagcagttatagaacagaacttcttatatttctttatttacaccacactctgaaaaaaaaaacccagttctatttgattaactatgaatagcaaagttttgtgacttgtgactcacttaaatcacccatctgaaattcatttacaaggtttttacattaataaaacagtagtgtggtacatgtattggactcagatgaagtctaaagtacactggactctagagagtggattacataccaacgaccaagattcaagtgtttggggaaaaaaataccttagacagtctatgttggcgtcaacactaaaataaaagg

SEQ ID NO: 658 - DNA, 385 bp, Homo sapiens
  Genbank Accession No. AA282343
aattttgtaaaaaatggtttatcaattccatttttgtataaaacacacgggagaaacctagccaatcaacacacaactgtcaccacatgaaaaggtacttttatcaaacttcgagtctaagaacatacaaatgtttcttttatcatgtctacagtaattgtctatgcttttccatttaactgttgttaaaaattccacatatccccattatttcttctgtcccagttacagtacaatgacggggaggaagagggttggttaaagcatccctctaagcagttttctgctgtcccttctttccaatcagagatttgtggatgtgagggatcacaccacccccagctatggtagccttgataagagaatccactcttcatcaccacga

SEQ ID NO: 659 - DNA, 400 bp, Homo sapiens
  Genbank Accession No. AA282505
ctttaaaaccatttacttacaaactttaattcagcaaaggtccgtgtggggagactggggtggggtcgggggaatagtccccttggagtggatgtggacccccagagtcaagggagggaagctggtggcccagttggctgggggcaaggccaggggtcacctcaggtcgacaggtcctgctggtgggcgggcccagagtttatcttcatggagtgctggtttctggcactgggctggaaggaggccagctccagggatctggcctggggtgggcaggcagaattcaagaattcatcttcaacaagcgagtgacagcagaggctccgggagatgggcacaatgtccgactcccacagacagacagcaggggactggcagagaaagcccatctctgcacgga

SEQ ID NO: 660 - DNA, 404 bp, Homo sapiens
  Genbank Accession No. AA282516
attttttttttccccactcccacttttatttagcaagagtaaatgcagcctaatgacagggcgtgggaagacctcctgctcaccagtgtgggcagagtgtagcgtggcctgggctcctaatacaggtaaattgtctccaaaggactagtaaaggtgactgggtcatcctcctgccccagggacactgattagagaaaatccgtctgtgctggcaatacggcagtgctggacactcggaattcccttgaaggcaaaagcaaggaacagagcgtgattaggtactggacacctgccaagtgctgggctctctccagtttacagatgaggaaactgaggctcctcgagttggagctgggatgccagcccccatggacctggcagaacacgctcttgacagccccaca

SEQ ID NO: 661 - DNA, 369 bp, Homo sapiens
  Genbank Accession No. AA282541
aatgattttaccactacctttttattttgcaggatgtgtaacaccttcccttgctttgtctgcttggcaaactccactccccttttagggtcacttcttctcagaggatgtgtctaactctctgcctttcatgcataataaaggccctgtcatctattctcccagagatcttgatatctttttataacatcaccaacattatatcactgatactcttcatagcagactgcatgctccatgaaggtaggaataatcatctttacaacatcagtgccttctcagtgaatggccataaaagttcagtgagtgaatgcttaataacttgaagtgaaaggagataaaaaaatcatagtaactcagaatgcacag

SEQ ID NO: 662 - DNA, 312 bp, Homo sapiens
  Genbank Accession No. AA282571
gctttattttgctttatcattttattggtaaaatttatttcaatgcaaaacatatacagagacaagtacacggtggtaaatgtatagctcaataaatctaatgaaataaacacaccaatgtaacagatcaagaaagaggacattactagcttccagatgccctatcatgtggcttcccagtttagttccctcaaggataatgaatattctgactattaatgtcatagatcagttttatcttcttttgaagtttatgtaagtggaatcttttctgtctggtcaatatcatgtttccgagattcatctatattg

SEQ ID NO: 663 - DNA, 315 bp, Homo sapiens
  Genbank Accession No. AA282886
aagaatacagcttcacatttattcatcattgtccattcactcattagttcatgcaaccacaaaaaggtattataagaataatatttcatttctgaggtaaggaaattatcatctagtatgtttttatataacctactattcacaatgacatgtagaattctctctgttattcaacatatgttcttgttcttcaaaatctgcaatatctgtagtctgattcttggagactggctcaccgcaattgtctagcagagctttagaccaggaagtgccacacagcaagtagtttccatcacagtcttagctagtttattc

SEQ ID NO: 664 - DNA, 314 bp, Homo sapiens
  Genbank Accession No. AA282956
tgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggta

SEQ ID NO: 665 - DNA, 226 bp, Homo sapiens
  Genbank Accession No. AA282971
tttttttttttttttttgaggactgaaataagagcatgatatttcacaatgaaaataaaaccaggccacgcaagaaccactgcggcctgcccgtgacttggcttcccctgcccagcatcctgtcctccctggtccatctctggtgaggacggctgggagtgggctctgtggctgctagcagggggcagggaggagctgggactgtgggtcgtcctggcccgtgggg

SEQ ID NO: 666 - DNA, 408 bp, Homo sapiens
  Genbank Accession No. AA283066
gattgtattcaaatttttattttttgaacaaaaatttaagacaatgattttaaataataaaacatggtatatattctagacactggttttttttaaagatttattaaatttagactcctatagttctgttgtgatgctttcttcaacatttatattatttcttaccattttatcatcactccaagcttgctaaacaaagaatctctctgttaagtgaagttttacattaaggaaatactccactagcacactgaacaaacctacagaactgtcctagtttatatttacaaaacacaagaagtctgtccagccattttggttttgttgttacactgtccatactgagatcagcagagagctaagtaatacacaagattacgcttcggcagtgcaaaggatggcatcaac

SEQ ID NO: 667 - DNA, 382 bp, Homo sapiens
  Genbank Accession No. AA283085
agatttttcatacacattttatgtacctattattacaaaaaagcttataatctgatggtagtagactgattgcttacttgaaaatattaacttcatacatatcaaaatacaccatcctcaactatataattggactgcaaaatgcttgatatgaagtatgtaaaaaaataagcagtttattataccttacaaccttataaagggttgctatctagtacaaagataacatttatcttataacaaaaatttgatagttttaaaggttagtattgtgtagggtattttccaaaagactaaagagataactcaggtaaaaagttagaaatgtataaaacaccatcagacaggtttttaaaaaacaacatattacaaaattagacaa

SEQ ID NO: 668 - DNA, 258 bp, Homo sapiens
  Genbank Accession No. AA283182
aagaaagacactggatcttttatttttttcctttcattttctttttcttaaaaaaacaaaatgaaaccaaaaaaaagcctgaatcaaaacctttttaggagtagttacagatattatagggatgggggcggggggcactaaaacaaaagagaaaagcaccagtgagatgtctttcccattttcttctctccgccacggaacacgcacaccaacagagcccaggccactttttgccctcttcccttggaaaaaggagga

SEQ ID NO: 669 - DNA, 520 bp, Homo sapiens
  Genbank Accession No. AA283711
tttttttttttttttttttgcttttccaactttatttagaaaaacaaatccaggtcccagtgccccctgtaccctccccgaccccagccataatttaaataacttagagacagagttggagggaggggacaggagaggttggggtcacggtggaaggaggaagagagcccactacagccgccgcagcgcccgcttcttgtccgtctttttcttggccgccagcttcttatcgcgctcgccagcatgcttcttggccatgggaccctcagcccctcccgggccccctggcgcaagggctcgggtggaggaagcttcagtgccactggccagggctcgaccggcttcggccctgccgctgggcccgccggcgccccacgtggatctctgtgagcagacgggcccgagctgcatactcctcgtagttctccaagagcaggcggcccgcttcctcgttgagtgcagactcggggttagggtggatcagcaggcacttgatggtcagcagtacgtgtcggatgcc

SEQ ID NO: 670 - DNA, 453 bp, Homo sapiens
  Genbank Accession No. AA283758
ttttttttttttgacagtttttaattgtgcctttattcaacttagttcattaaaaatgttttaaagatcctataaataaagtgaccactcacatgggatataggtcacccctcagcatgttattttttttcttaaaaagcagtatttcttacaggaatcttactgatcacacggtagttacaataatgtcagatatgatgtatacagtctaaacgagacagtccagttaagaatatacataatgtaaaaatacacatattaaaagttagccaagtggacagacgcatgcgggggtggggggagcaggtgacaggaactcctttaacaatcagtagagggcccagatgcaaagaatctggttttccccgttacagtaaacagctttcactaacgtatacaggtatttcatacacatctaaacacacaagggtaagttgtgacctgctacacata

SEQ ID NO: 671 - DNA, 334 bp, Homo sapiens
  Genbank Accession No. AA283759
tttttttttttcagagtgggaaacgtgtttattgtttgatcagtctcaggcctggttggggggtggaaggcaggactggggtcccttccccaacaacagcgcagaagccccaggaagatggcgcagattcctgacgacccacagccaccttttatgaggccagagactttacacaccacactccccacctccatccagtcaaggctctgcgatggaacagctgatatctttaggctagaggactccattctgtgtaggggctcattcccatctcagctccagaacacggaggacctgaagattactcacggattcctccttcaggcagggctct

SEQ ID NO: 672 - DNA, 297 bp, Homo sapiens
  Genbank Accession No. AA283832
aaagtaataaacttattttaatagtgcaaaatgtaatctgctttccaaccaatgaaagaaaaacttgcaaaaaatttatgaaactagtcaataccttgaacaaagaaaaacacaaataactaagtaaatattacaattgtgtactccaaacccaaaaaagcagagaccgtcattacaagccaaatcttttttagagttggttgttgcaggttactaaaatgcgtaaaacaaaatctctacttttcagacttacagaaaagaaataactccaataagaaagctaacttaaggtttcat

SEQ ID NO: 673 - DNA, 242 bp, Homo sapiens
  Genbank Accession No. AA284153
tgcacaaaaaagagcagtaaaataaatactcagaactttcccaggttgtcaactattaaaataaaacctcagcatttcaaaaaagcttattccgctgcaggaaagaaggtggacatttttggtaccataataaatcacacactcacacatccatattgcttaggttgaagagaacggaatgaacagaggaaatttcttccatgaattgccctcctttcggtacccgccatgttttagttacc

SEQ ID NO: 674 - DNA, 404 bp, Homo sapiens
  Genbank Accession No. AA284558
tttttttttgggcagcagaatcaggtttattggagggatttgacattgctgaatcgggacactggatagagcagctggacaggagttggtggcagtcctggaaccctggatcttaagaaatagagaaactttccattcttggagtgcataatggctctcttaataaactctacaacagattgacagcggtcctcaaacttgggatgacaccacaggctgaaggttcctctgtagtgctccattctagtgtggtgggtgataccctgtgatcggaaactgaggctcaggatgtaacgaggatcagaactgtctcgtaccaggaaagaaccatctggtttccctttcagcttcatctctgcatcttcccaattcattggcccccaataccaaccacacttctccaa

SEQ ID NO: 675 - DNA, 238 bp, Homo sapiens
  Genbank Accession No. AA284565
atcaaaagtttgttttattttcaatacaagataaataccatgcttgttactagtgcagtttaaggccgacaatggccatatatcaaactgccgaacagtcacctaaatgctaaagaaaggaaagacaaagtaaacattaaacacaaaattgcaattacaaacattttaataaaatggaatgagctttttaattgaagctaatatgaagtctaattctcatggacagcaaaaaaaaaaa

SEQ ID NO: 676 - DNA, 316 bp, Homo sapiens
  Genbank Accession No. AA284720
ttttttttttttttttttttttttttttttttttctgttacaaacaggtctttattaaagatgagaagccaggtctttattaaagatgaggagggggcaggaaaggggggcagtgctcctctacccactgcctttgcctgcccggggtgagggagcccctctgctccacccatgccccccatgatggcacatctgtatgaggctgaggcatggggggcagtgtgaagaacaggggcaggttccaagaaaaagaagaaaaacccttcccacagccctaataaataacagaagggtttgggatgacctgggcacaggc

SEQ ID NO: 677 - DNA, 225 bp, Homo sapiens
  Genbank Accession No. AA284721
ttttttttttttttttttttaaaaaaaaccatgaatcatttattctttggttgtatacacagacacttaagtactgtatcgctgttatgcagcggcctgtggaggccctgggggtggctgggcctgtgtcctgagccctcagccagatccagggggtgcggtgtctggtcatgtccactccaagagcagtagcaccatgtagaaggctgtgagcagggtcccctc

SEQ ID NO: 678 - DNA, 478 bp, Homo sapiens
  Genbank Accession No. AA284795
ttttggggtcagggtgcctttattggtgaatgggaatgtgtgggttggagctcaatggccatatgtcggcacgtccagggtccccaaggcagcaggttccaaggcactggggcagcccacgccgggggaggcccctgagcagcaggcaccattctcgccctggcagggcctgccacttggggagagcggaggctggccaggccttcagcaaagctgttgcagctcaatcagctcctcttgtgggacccggaggctttctgccggtagatctcagcggtgaagggctcttcgtataggagagccattatgtaggtgagggccaccagcaccgtcaggagtaggcccgtgggcgtggcgtgcatgatggcccagccaggtagttggctgtgcttccccagtacatggggttgtccaggatgttgaaggggaacacggtcactctcgcctccttgaggatcccgaagtaatcacctaggaa

SEQ ID NO: 679 - DNA, 428 bp, Homo sapiens
  Genbank Accession No. AA284879
ttttttttttgattagtcaaatatttttattttgccaaagaactctaaaagcctttggtgattcccaaacatacaatgaaccccaaataaaacaaaaccaaattgcactattacaaaggaacaagtccatgaaagtagagaggaggcgccagttaagggacagcaacttcaaggagacggttgttttttcgtttacatgttgggacactcccatttttctggtttccctgaataaacttcacacatactttgtccggtctgaacaggtccagggctccaccggaaactccaatattgagcctccggttgggtttggcctaaaatttttgcggaagaacctgggtgggccatttcaaaccaagtggatccctcctgaaaagaaaagttcccttactaactgcttctgagccctcctttaagtggacggc

SEQ ID NO: 680 - DNA, 421 bp, Homo sapiens
  Genbank Accession No. AA284945
ttattttgccagtgcagaaacgtttaatagaaataaaaaggtctgcatagagccgaggccggagccacccctctgccgcacatccagtacagagaggattctataaagttcacactttttcattaagtagtagtagaaatacggtgaggccctgagactggcctggtgagcgaggaaaggccgctggggcgttccactctgcaggccggggctgaaataacccgagttccgttctcacagaaaggtgcggctgccacctcttgacacagaggccggatgggcaggtgtcctcgatggccaggccgtatcagggtacaaccgcagcagtgcaaggggcttcctcaaggacaaatggctaaaaatgtcacggtgaaaatgtcatccccaaagagttcgttctccctagacccgtgggggcaac

SEQ ID NO: 681 - DNA, 425 bp, Homo sapiens
  Genbank Accession No. AA285053
aaaatatctagtggccaagaggtctacaatgacacactttgtagaaaccacacaggacattaacgtaagtttaccttctagtaattattttacaaatgtgttatttcaattagattacatattaagacactgctatgctgtaacagcactgggatgtcactaattaaggctgtaatagggcaaaagtgaactcctaataaatactgaattagagatttcttctacaagtctgtgagtttaagacaggttcaaaactaaaataagaaaaaaacactgaaaaccactttgctcacataatttatatgttaactaaaatatgtattgttcacaggttactaatccatttcaaagtgtagattttatacaaagaatatcacagaaatattttacctccctctgatgttaactctgataagctatgggat

SEQ ID NO: 682 - DNA, 349 bp, Homo sapiens
  Genbank Accession No. AA285132
ttttttttttttttgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttc

SEQ ID NO: 683 - DNA, 310 bp, Homo sapiens
  Genbank Accession No. AA286710
tttttctgaaaactttttaattcacatatagcaatttgtacattatagcaaaatttgcattattcaagaataagttacttgtacagtacataaaacaatacataaaaatttgccaaataccttctgcctataatgatacaagatgaatccactttatgttatcacaatgtgctgtatattctaaccaaacacaggatgtcagatgtgtccttgttaatatactcgcaagttcctctagcttgtgggagatgttagagctaacacatttgcagtaagggacttagtcctgaatagaaagcatgaaggaatc

SEQ ID NO: 684 - DNA, 473 bp, Homo sapiens
  Genbank Accession No. AA286911
aggtgtgcatgtaataacaaaacacaatagatttccattagaaccatcctttaattcaataaattctttggatgaactctgtaaatagactactgacacatagcactcaaaaagtcttatgaaccttaaaacacaaagtagtagactgggtagacatagggacaatacagctcatcatttcatttttgacatgttggacttcaccatgcaagtaaattaatgcatatatgatattttgttttgttttgagaaagggtcttactgtgttacccaggctggaatgcagtggcaatgatcttggctcacagcaaattctgtctcctgggctcaagtgatcctcccaccccagcctcccaagtaggtgggactaagatgcatacctctatgctcagctaatttttaaacttttttttgtagagatgaggtctcactatattgctcaggctggtcttgaactctcgaagtgttgggat

SEQ ID NO: 685 - DNA, 361 bp, Homo sapiens
  Genbank Accession No. AA287022
gaattttcaattagttaatttcataagctacagcagaggcgtggaccctgccctctccacacttgaagagataagcccctgggatccaagtcccagcaaggttggtgccacccatcttggtgaaagatgctgttgttcctgtggaaaccatcaccagaggtaggaagggctttgagcccaaaaggaaacaagagggcgtgaatccaggccatcctcaggggagggtgggagcccatcccaggcagagaggcctaagcctcagtgtgggccaaggctcaaaggtgctggcacaaggcttcccagggggagaatcagaaactcagcagtgaaagtccgcagaagggggaagaagcaggctgat

SEQ ID NO: 686 - DNA, 389 bp, Homo sapiens
  Genbank Accession No. AA287122
ccttttaaatgcttcttttatttcattggttgtacattgggtgagtgaactgaatattacaaccaaaacatagtattgatacaaattagactcctgtttacactgtaaggtaatgaatgagggaattctttaagtgttacagaaagatttagtagaaatgttaccagtggtatggctgaaagaatatttcggtgaagtgctgttatatcctgaaaaccaagagtgaaatgtagttcccatacaagtggagagttagtctcttaactacagtatttgttgaactgatatcttcatgtcttggatattggtgatttttgttttttaattaaacaaagcatttaagatttattcatcatagtcagacttctgaatataaacaaacttttggc

SEQ ID NO: 687 - DNA, 406 bp, Homo sapiens
  Genbank Accession No. AA287347
ttttttttttttttttaaatttaagacagttacatgtctttattacataaacatcataatatttctcataggagttggtcttcagtttgcttgttgctttcgcagaatgtcaaatatctatagaaaatgtctaattatttatgaacaaacattcccatccctgccccgcaaaaaatctcattgcctgcaattcctaaccagattcctgagaaaaataataggatttattttatagcatcatacatagattttctttcaagatataaaaaaggacagacttctaaaacatgaatctcctttcgtttacaaagttctataaaaatacattaagtatgttcaaatgtttgttctttcactttatattccagtttaccagaaacaaaaaatggcagtacataaggatatg

SEQ ID NO: 688 - DNA, 321 bp, Homo sapiens
  Genbank Accession No. AA287393
ggaagttagaaaagtctctttttaagtttttaaattaaaatttcgccctggtgagatgggattctgattcgggaactaaacccaaaggcaggctctccactttggacctggacacgcagcgggaggggcagggcgcccagggcagtcaagtcccctgctgggcagagcgtggcgctttgaccaaagtcagctcctcagtgccacatcagccctgcacattcagcaggagacaggggtgatgagctatggggccacaaccagcaatcagaggtggggaagaggccatggggagagagccctgataccaagagggccttccac

SEQ ID NO: 689 - DNA, 425 bp, Homo sapiens
  Genbank Accession No. AA287550
tgggggtttttaaggtgccgcatgttctttttagtttccatacatcgtctgtcccagagtgaggagaagttgatctccttcccacatccaccggaggctgcgtgagggaagcctggctccccacaacttgctccttctccagccctgcccctctcaattaaaacaatgctttcttttttcttttcttttttttgagacggagtcttgctctgtcacccgggctggagtgcagtggcgcgatcttggctcactgcaagctccgcctcctgggttcacaccattctccagcctcagcctcccaagctgctgggactacaggcgcccaccaccacgccaagctaattttttgtatttttttagtagagacagggtttcactgtgttagccaggatggtctcaatctcccaaccttgtgatccacccac

SEQ ID NO: 690 - DNA, 490 bp, Homo sapiens
  Genbank Accession No. AA287566
ttttttttttttttttttttttgcagcagaaaaagagtttaataatcacaatgccattgggcaaagagatgaaggaatcctcaagcttcacatctgtctgcttgaggggttctgggccagggtttttaaggggattgtggcgggtgaggttctggagaattggggttgtcaattgctcaggtcaaggaagattaaatcatcatgatgtgaaaacttcattcttctgtgagtcggctccttgctgggaccttcagatcaactggcatcaacaattttatcagtatgcgtaacataaaggagaaactcaaacagaaagcatatcatctcatgtgccttagatcttatctatagaaaagaaaaggaacacagtcttgtgacaagggctacactatcttgggggagtaagaagtaactagctacaaggaagtaggccaaattgggaagtggatttcatgattgccactgattattctgcaagcctagttgaatt

SEQ ID NO: 691 - DNA, 505 bp, Homo sapiens
  Genbank Accession No. AA290594
gtaacttttttgtttttctttctgcttcattatgaagataactacaggaatatataacattagttcctgttttccaccctgtgaatttacctgaattcatagaatccttgcgtgctttaagcaaaaaatgtattttgtattgaaattgattcttatctcaattccagacacctatacagtgctggagacacctaccctacaccacgaaatgccagacagtaattcctagatcaaagtaaatgatctaaagcatgcatcacatctgatctggaagtggtccagaaacaggtgtgttgcatcttctgtagctgtaaatagagattctggaagggtgatactgtttccttttcagggtaaataacccatacttgttatgccatcaagccaagcagcaaatgaataatgtcatgaaaatattattagaacaaattaacaaattacaattacaattatcaaattaacaattagaatatagtagcaccatcattctaaaaatttaaatttg

SEQ ID NO: 692 - DNA, 375 bp, Homo sapiens
  Genbank Accession No. AA290674
cttggccctaggcggaaggtggcttttatttcctctcttggggaaggagggggagggagctttcccaagcacatcaacctaaggaaggggtggttgcgcccccagcagcgaggggatggaactgctgatcattcggaaggaagggttcgttcttgtccacttcctggcccttggctgcagggtgtgctggcaggggtcactcccctatgggtggcagctcctgcatcagtggaggcacaaggaggtatctgctggtgttcacgaagaggagggggcaggtgccatgagtgagggagaaagggctggggtgtccgaccccacgccaacgcctgcccagtatgatcactttcataaggcctggctggtgggactcct

SEQ ID NO: 693 - DNA, 236 bp, Homo sapiens
  Genbank Accession No. AA290776
ggaagttatgaaagaggcttttaatgaaaatactgtacagtttatgtgaggcaaaggcagggggccttgtccaggaagggaagaggcccaagaggcttcctgtccccttggggcaggcagagccaaatgcttgggctcgggccaagctgcctgccctgcagggtccagggaggtcctgatgagtcctgccccttcccttccagagggcctgcctggcagccagcagcagggtgttt

SEQ ID NO: 694 - DNA, 351 bp, Homo sapiens
  Genbank Accession No. AA291137
ctgtggatgatcaattttaatacaattatacattcatgctgtggtggtaacaactttcacattatttgtaggactacttttctcaactcatgacaaaggcacaatccaaaagtataaattaacattacaataagttttaaacaaatgtggacaaaggaccaatctgaagtattaaacagaaaacatctgaatatggatcaacttgaatatattttcattccagaaaatattttgtcttttcaacactgtctcattttgctatgatggcagttttgtgtacctggtgacttactcttaatacccattcaacatgtaacaattataattaagcattcacatactggatagaca

SEQ ID NO: 695 - DNA, 408 bp, Homo sapiens
  Genbank Accession No. AA291139
tttttttttttttttttaacaattttacattgacttttatttaataaaaccacctatttacaattcaaaaaagtcctactttgatacactttactaaataaaattaaaggttaactgtacaagcaattaaaacatgatatgtagcaagtgttatcaggagttttcagcaaactatttaaaatagtcaaaaactgagcagttaaaaagtaccttctgaagtgaatgccgtttctaaatgggatcccaatgcctggcgggagaggcagcctcactctactgtgcaggctggacaaaggtcccggccctgaagtcttagactgtgagagtcaacggcatgtgaagtggagtgtgcagacctctggaggagcagcacgtcaatgtctcatttccagtttacttaaaccacac

SEQ ID NO: 696 - DNA, 327 bp, Homo sapiens
  Genbank Accession No. AA291168
ttttttgaaaggtaagtaccattttatttagtgttgtaggaaatgttgggttacttcttaaaaacgaaaccaaagaaattcaaaagtcccaaagaaagaaagcaggaaataataattctataatccaaaaacgttgggcgatccttcagttggaggaagagggcgtcagttaagtagctcacacagtagatatggagacaccatatggagatacggagttaagtttggtggatactaggaattaagttctccacctaaggcaattaatttttcagccttgagagataattagtagttctagaaaaagaaaaaaagttgactgggaga

SEQ ID NO: 697 - DNA, 299 bp, Homo sapiens
  Genbank Accession No. AA291259
gttttagttcagtttattttttaatatgtcctgagttctttctgttcataaaattatgatcttatgacagctgtaacttttaattaataatattaacaaatcattattgatataggcttttcaatttgctcaagattaggaattgtaagtggaatgaagcagcacttccagttgacaaatggatccaaaggtaatccaatgtcttttaaattaagcttgtgacaattaaaccaatacactgtagcaatgagaaaactattgacaaagtataaccagggaatattcatctcaatatatgc

SEQ ID NO: 698 - DNA, 394 bp, Homo sapiens
  Genbank Accession No. AA291293
caagatagagggtttttattgaaagtaggttatgcaaacttggcttgaaaggtacttatcattttaaaaattatgcctaatgatgcatcaaatacaaaaacatataatacatcaatagtcaaccctttccccataaaggcaaagttactgagaaatgtttatttttcctctggtaatggctaatccaggtaataatatgaaagcaaatggaaaattcacattgcttctttcattgcttctgtcccttaaacctgttaatctttcagaaccacattactgaggtgctggcctgtgcatggaaacccaatgatatccaggtcttacaggtccagggcccagtggacagacaggccctggtcctccacgctggccaccatgtcttcgatggcattcc

SEQ ID NO: 699 - DNA, 546 bp, Homo sapiens
  Genbank Accession No. AA291323
  unsure (1)..(546): n = a or c or g or t
ttttttttttttttttgctggaaaccaacattttattgagcactcctgctcctcggaatctattccagtagattctttgccgagggatcacatatcacacaggggtgtgaccagcactccccctgctacctgccgtgtgggcagggcaggagtgaatggctcttcctgggcacaggccacagttaaccggtgacaattgcagagccataggaattcatcttttagaaaaaacgaaaactggaataaaaaaaaaacaaaaaacctgagtataaaacctcagcagtgttccagcactatctcggggtttaaatataaaaaggcatcatgagaaaacagttaaaaagataacagcagcagggcgccacctcccagggcaattggtcatgnggggttgggccaagcctggtcttgaaccgccggggggcttacttgtagcagcaggtgcaagcccccgctgagcaacggcaaaagcaacgccacaaggcagcagcacgccacaaggacctgttttccagggacccaggaccggggttctggggttttcca

SEQ ID NO: 700 - DNA, 244 bp, Homo sapiens
  Genbank Accession No. AA291456
gactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 701 - DNA, 330 bp, Homo sapiens
  Genbank Accession No. AA291644
gggtgtggaaacatgtgagtgtattatttatttttgaataaataatacaataaaatataaaacatacacttattgtggccctctgcacaagcaatctggttgtgcagagtcttggtgtcccctgctagtcttagtacctgtatagagctcttcagactgggtgtcgtgttgcagaggctagcaccattcctgatgtcaccctgggtgagacgtggtcctcagaatccagatttccttttttgtctttttccttcttccacatgttctaagaaaacatagatttctggccaggcatggtggctcacgcctgtaatcccagtactttgggag

SEQ ID NO: 702 - DNA, 262 bp, Homo sapiens
  Genbank Accession No. AA291659
ttactagtgtgattgcatttattcttataaatgtacagagctgtagaagtgcaagccaagagttctatagagtagtacataaacaccatatggtaccactcctgctgggaggtaagcctggatacacccctctcctcaggaaactgtcacctgcagaacacacagcactcagaattaaggcagtttggccctgggcacattggtggtattttggtatgtggccactggcgctaaacaactgaccatttctaccctgcctcac

SEQ ID NO: 703 - DNA, 214 bp, Homo sapiens
  Genbank Accession No. AA291749
tttagttgtaattctttatttgaacatcaaataggttgagaaaattgtttacaggtgctcgagcatcccgctggattctttttcaaagtgcaaaagaggtttacaagtgtgtttcattaaacaaagcaaagctgcgacaaaaccgagtcacatcagtaatagtatgcatcggcaaaagggcatattaatccatcaaacacaatttggcatttga

SEQ ID NO: 704 - DNA, 187 bp, Homo sapiens
  Genbank Accession No. AA291786
gtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaaaaaaaaaaaacc

SEQ ID NO: 705 - DNA, 312 bp, Homo sapiens
  Genbank Accession No. AA292086
gatattgtagacctttattttctttaaatctcctaataaaaacattaaactttcaagaagattccaaactgacattgcatagaccaactcctttccaaaaatatctctgatatactctccaactctctcaatatatagaatttgaagtccaggagctgtgggcacctggtgggaattcactgagctcaaggggacaagagggctgaggacagggctcccacatggggacaaggccaggctttctggcctctggttccagccagcatcaatttggttgtggccaaattctcagtccaatcaccctggcccagg

SEQ ID NO: 706 - DNA, 329 bp, Homo sapiens
  Genbank Accession No. AA292158
tcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 707 - DNA, 431 bp, Homo sapiens
  Genbank Accession No. AA292328
atagagacagggtcttactatgttgcccaggctggtattgacctcctggcctcaaacgatcctcctgccttggcctcccaaagtgctgggattacaagcataagccactgcacccggccgagaggggtttggaatgaaggtagaggcagggggatgaaggcgccagagctgaagaccagcccccagaagccacacccctgcccttctagcagctacgggtcctctggctccgggccttgtaaacctcgatgagcaggtccttgacgtactggatctcgcgctccacggactctgcccgttccttcagctcgcgattccgtgcctccagcccctggaactcgaccctccagggcctcaccctctgcccgcttccgctggcggtacctcagagccgccgacttgttctggtctctctacttttgcttgcggtc

SEQ ID NO: 708 - DNA, 338 bp, Homo sapiens
  Genbank Accession No. AA292379
ttgttttttttttagacttttgtgttttatttaaaaaaaaaaaagtgtgaagtaagacaaaatggacctctaccaagttgtagggaaggacaaggaaaagaccaggggtagaaaaggagtgtaagttttagaatggtggcattggcatagatgtgggaagagtataaaactagaagaagtctccagataaaaatatgcaaaatatgtctgtttaagtataaacattttctgtccacatgcaaagaggtgtttacccacccaaaaagggtatatgttggagtggggacttcactcgcgctggatatgtattaccctccagcctggaaactttgtcttgg

SEQ ID NO: 709 - DNA, 431 bp, Homo sapiens
  Genbank Accession No. AA292440
cagaggctttagaaatttattacaaggccctcatagtagaaataaaaatatagatatctatgcttcccatctcgctctcagtggttcgaataacaagtgcaagtaacaaaatagattgtctctataattcgcaaactgggagttcatgggtacagagcaacttcagccccagctcccaagtcccaaagtgtggtcttgtcgagggtgcagacaaggaccaaccaagttcaaccaagtctctcgtatgcagacgccagctccagtctcaaggagggtggggcttgcagtcagtctcactccacccccgagtggacagtctggaccctccgtgatggggaaggcggcacgtgccccgccactccggcttctgctccatcccaaggcctcagcttcgggggtcctgtctcctgctggcctgggtcccccttctc

SEQ ID NO: 710 - DNA, 340 bp, Homo sapiens
  Genbank Accession No. AA292659
ggttttggacatataagtttaattacctgctagactatcagatggaaatatgtggtaaatggatggaaacaaggtacataaacttaggaggcagaaatttttaaactttagggttagacattcaccagattggacaatttttaacatttaaaataaaactttttgtcataaaaaacaaatgtattaaaactagtttccagaactgcccaaatgactttttaaacatgacttaaatgtcgttttgacaaatctatccaaaatactaatttaccttttagaacttagtttataatttatatattaaagtgcccttaattgatattcattgggataccttcct

SEQ ID NO: 711 - DNA, 391 bp, Homo sapiens
  Genbank Accession No. AA292711
aaagccatgtaaaacccgaagcattaaaatttattaaatgatgcaataacaacagaattctttatttacaatagcattatttaacatcaaataagcaaatagcatcagcaaagcaatattaacttgcataaatgtatttaaaatttctctgaatatatctacctttgcataaactgctcacactagaaatacaaacatcaatgcaggtgaacaaagtgatgttcagagtcaactccattttgaaaataaatcacaacctgaaacactgtaagctttctcctgaagaaccatagttaatatattgcttaattttacccttgtataatcttttcatatacacacatctcagatgcaacttcatgaggaactgtacaaataaaactcacaaatg

SEQ ID NO: 712 - DNA, 412 bp, Homo sapiens
  Genbank Accession No. AA292765
ttaaatgtataaccttaaatatttatttgagaaaacaaataaagatccaaatacgtgagttgatcatctgataaaagtaagagttgacaaaaaaggtacatcttctccaatccgaaaacagaaagtgggaaagatcaaggtatcactagaggtcaatgaaacaaaacatacaatagtggatgacaaaagccaatctctgaatctttgaaaagaatataataaatgaacatctgaaaccagtgatcgagaaatgttttagataaggcacaaaaagataccaagaatgttaacactaggctgtacatcctaaaacagtcagatgagctcactgttataattctggttcaccgcaagaaccttagcacaaagaaaggactcaacaaacatttggatccatgaataaaattatctt

SEQ ID NO: 713 - DNA, 251 bp, Homo sapiens
  Genbank Accession No. AA292773
tttacactctttggcttccttttatttcttgaggattacatgaaacgtgaactatacaggaaagtatggcagccaggtcctggggccaggggctggcggctgctccctgcccacggtgggggcttcctccgagccgccggtcctctccggccatctgcatccaggcggtggctacttggaggcagtcatgaagctgttctcaatgcagagcacgatgtaggcgtgatggcagctcgcggcactctgcccca

SEQ ID NO: 714 - DNA, 407 bp, Homo sapiens
  Genbank Accession No. AA292788
  unsure (1)..(407): n = a or c or g or t
cacagctgaattacatttactgtacaaagaacggttcggagagaaccaggaatggcggagtgtctaacagcagccgcngtagtgttgatgccgtgaatgcaggaccatccaggtcctcaaagtctgtgaggtttgttcataatcccaaacaagggccctgctggcagcaacaggacaggtggggccaggacagggaagctggagcaggaggccagtgtctttgggggctgtggcagggcgcctgcatggggttcccttactcatctggtagttcatgcaggccacggcgctcatctcccaggaacgggccatggggcgagtccactggtgcccagtaacaccctccgtgggaccaccttgggaagcatgtgccgcggagtccaccacggggggtcctgggtcccggg

SEQ ID NO: 715 - DNA, 500 bp, Homo sapiens
  Genbank Accession No. AA292931
ttttggaataccattgtgtttattgatcaaacctggcttcgagtgtgacagagccattcttggttctccttggaagtaacaagaacactgggtaacatgtgaagtgcatggagactcacctgaatcccaccaaagtagtagctggacccagtagcctagcttattgtcttggcagtgcccctacccagtaccattagacctggctttgtcccttacataggacagactgggcttctccactcccgccaggctggccctacctccacctgtccttggaagctagtatgtaagtaagggaggagtcatcaagtttatagatgggtaggctgaggattgaggcaggaggggacttaatggctgagtccctggcttgttccagagccctggcccttgagcccctggactggtcagtgcatggacactctcccctcccagctcgggcggaagacttttcctgacttagctgctccatacacacaatctataaatatgtatttgct

SEQ ID NO: 716 - DNA, 445 bp, Homo sapiens
  Genbank Accession No. AA293327
ggtaattagcacttaattttaattaaaatcaacagttcaggagaagataagatagtgtttaatatcaatttctgagaaatcacatttatataaaagaaataaaacaggccagcagaagtccaaaaaagattcagcttacattattgcacttggatgaaatatgctatttagagtagtataatattcaggccaggccaggaggagaaagagaaaaatggagaggacaaacctccaggtagtatttattccggattccaaactctcctgcggcctaaacagtatttagtctattggaaacattcagcaaggtctttacaaaaatgactgcagtatcttcaacacatttgagttgcactcatacttcgttccagtcatgtgcaagtttaatgcacagctctacctcacaaaacgggatatctatgacaccagaacttccctgtgccca

SEQ ID NO: 717 - DNA, 321 bp, Homo sapiens
  Genbank Accession No. AA293420
ggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaa

SEQ ID NO: 718 - DNA, 198 bp, Homo sapiens
  Genbank Accession No. AA293485
ataatattgattttaaatagtggagatagggtctcactctgttgtccacgctggtcttgcctcaagtagtcctcctgcctcagcctcccagagtgctgggattacagatgtcaaccacttcacccagcctgtgctgtctttattgaaaatagcaagcgatgattttccaaaccagaaggccaagcaggaaagcccagc

SEQ ID NO: 719 - DNA, 412 bp, Homo sapiens
  Genbank Accession No. AA293589
ttttttttttttttttccagttctaaaaccaaatctttattctctagtttgaaaaggaggggtaaatggttgttctgtttagttccagagaacagaacaaggcccaataggtagaaattataggaaagcagaattcattcattataaggaaggatttctaacaattagaatttctaacaattagaatcatccagggcctcaggaggtgcggaagttcctgtcacctaagtgctcaagcagaggccaggtgtccatatgctagaaatggagaaaaggaaactcaccagcaacttcccctcagctggccctccatcaccaatgcggcagtccttgccgtgacatgctgagctctggaaggagcgaaggaggggctgcggtgttcagacaagagcctggacacagtgctgctgac

SEQ ID NO: 720 - DNA, 326 bp, Homo sapiens
  Genbank Accession No. AA293719
caaagtattcaagggctttattggggccgccctggctgcccctcacagtgttgcaagaacccgctggtcttgctgttgcctttgctctttgggggcttgagaggaaaggcagagggaggaccaacttatctgggagagagaaggcccatctttggggctaagaccaggtggtgcggaacgagatttagggaggggagggcctacttaggggctggaaggggatggggctgcctcctggagtgtggtggtcacagagtgttggctttgtgggagggaaaggaaagggaggcacacaagaagtcaggaagagtggatgggcggtgctt

SEQ ID NO: 721 - DNA, 340 bp, Homo sapiens
  Genbank Accession No. AA293868
aaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaact

SEQ ID NO: 722 - DNA, 227 bp, Homo sapiens
  Genbank Accession No. AA295819
  unsure (1)..(227): n = a or c or g or t
cccccatctgaccagaaacatgccaatcctgagaataacctcccctccagccagagatattccaactntgcaataaaactntccttcacacagaaacattcgcagcctgcggtaggctcccccttcctaaacccttaaatgcccttagtctgtaagagaatgtccctgaccgaaatcggccagaagcccctctnaggtttattcccaaaataaacctgtctctgttg

SEQ ID NO: 723 - DNA, 216 bp, Homo sapiens
  Genbank Accession No. AA296821
cttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgc

SEQ ID NO: 724 - DNA, 280 bp, Homo sapiens
  Genbank Accession No. AA296994
  unsure (1)..(280): n = a or c or g or t
tatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggnaagtt

SEQ ID NO: 725 - DNA, 239 bp, Homo sapiens
  Genbank Accession No. AA297532
  unsure (1)..(239): n = a or c or g or t
ctaaatgctttaattttttgtcacaaatatttctgcatctctcagtcccttcttgttggaaaaaggagggctagtgatacatttgttaatggcacttttaaaangtgctttggtatatagaggnaacaatgtacttcnnaggnatgttaataataaattaaggttataatggttgccatatcngagngaatgnataagattagtctcagcaaaaacaaaaattagtttggaagtagata

SEQ ID NO: 726 - DNA, 313 bp, Homo sapiens
  Genbank Accession No. AA298180
  unsure (1)..(313): n = a or c or g or t
ctccagtggctttagcagtgactgtttgacataaaacatgtaaganttgcttgttgggaagagtgctttagggacccactgttttcatttctncttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagagggccactttcccaaagttatttcctataaagc

SEQ ID NO: 727 - DNA, 313 bp, Homo sapiens
  Genbank Accession No. AA298786
  unsure (1)..(313): n = a or c or g or t
cgttaccatcgtccgtgcgcaccgcccggcgtccagatttggcaattnttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaat

SEQ ID NO: 728 - DNA, 288 bp, Homo sapiens
  Genbank Accession No. AA299632
  unsure (1)..(288): n = a or c or g or t
agtcatcagaggatccaggccagattacagcccacctccctggnggatagtcggaagatgctacccttacccatgtcacagtggttggggaaaattcccccaacgtgagcgcctatgaacccatgagccagggtacagaggagggagaagtgggaatctaaccttccttctctctntnctacagaatagactgtntgacttccaagtcactaaattcattgatatgcctgtcccaggcagttccccaggtgaatttgncaaaattctggntgtatncccacaaataaa

SEQ ID NO: 729 - DNA, 487 bp, Homo sapiens
  Genbank Accession No. AA306121
tcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaatctttt

SEQ ID NO: 730 - DNA, 380 bp, Homo sapiens
  Genbank Accession No. AA307748
  unsure (1)..(380): n = a or c or g or t
cgggcttccacttcaccatcggatgtttgcnactcanactgagggggagctcagagtgacccaaattctcaaagaaaagtttccacgagctacagctataaaagtnactgacatttcnggaggttgtggggcgatgtatgaaattaaaattgaatcagaagaatttaaggagaagagaactgtccagcagcaccagatggttaatcaggcactaaaagaagaaatcaaagagatgcatggtttgcggatatttacctctgtccccaaacgctgaccacgccctggctgcatagatgctgctgctttaagaccttgggatggaactttcactggacattcatttcttnccctaaggcagtcacccaaaaaattttgttata

SEQ ID NO: 731 - DNA, 324 bp, Homo sapiens
  Genbank Accession No. AA312946
  unsure (1)..(324): n = a or c or g or t
gaagttaaaggncactttattnactgacagattgaaaactgtaactccaggnagtgcaaaatgcaccacaacccaattacaaagaacaggtgttaacacacaatgtttaaacaatgctacactcatttttggcaaagtgctgtattgttcagtctgtgtacaaaactgaccatctatganccaatcagtataaaaaatttctataaaancaaaatttagncagtggctcaagaaaacaagctgccatttatgcatagnntgatgtacagnaacctaaccaaatgtcccttttgaattttcaagttactgaaaaaaaatgtgtcg

SEQ ID NO: 732 - DNA, 473 bp, Homo sapiens
  Genbank Accession No. AA313213
  unsure (1)..(473): n = a or c or g or t
gaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagctcccgccccggaagcggangcttacaagctngagcgcctagccgaggcagagaagtcccaactaattatgcaggcggaggcagaagccgcgtctntgcggatgcgtggggaagct

SEQ ID NO: 733 - DNA, 493 bp, Homo sapiens
  Genbank Accession No. AA314457
tgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggcttttgttttt

SEQ ID NO: 734 - DNA, 573 bp, Homo sapiens
  Genbank Accession No. AA316272
  unsure (1)..(573): n = a or c or g or t
tgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgantatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagantttagaatgtatttgatgatagcattctcactaagacacatgagaatttaactttataaccgcgtgagttaagatttaattcataggttttgatgtcattgttgaagtatttgtaattcagaaaccttgcttgtgtgatacataggtaagtctcttcatttattactgcttg

SEQ ID NO: 735 - DNA, 284 bp, Homo sapiens
  Genbank Accession No. AA320369
  unsure (1)..(284): n = a or c or g or t
cccgcctccaccactttccaccatcagctgccaaactggtccctctgtntccctggggccttgggttctgtttgggggtcatgaccttcctagtttcctgacgcagggaatacaggggagagggttgtccttccccccagcaaatgcaataatgccctcacccctcctgagaggagccccctccctgtggagcctgtnanctccgcatttnacacggagtctgctgtgaaccccgcaaactcctccccaacttccatcttttctttccagggcccatccctggg

SEQ ID NO: 736 - DNA, 323 bp, Homo sapiens
  Genbank Accession No. AA321833
  unsure (1)..(323): n = a or c or g or t
ctgggtgcaagaggtttatttgggagccatcccaggaagcccaaggcgggggagtggggaagagagggaagggagagcccccgcagaagtacatgaatgagtgggttactgctgcgggcaactgggactccatcctgctgggcatcctctgagagtttatgtagaatacacttcagaattgtcctgctcaaggacaatgaagctgaggtcctgctccttattgactcagggttgctgctcctggggacattaaccccccaacacttctagcttncccagtgcactgactnagcacacagctatggccaccagggaaccttttt

SEQ ID NO: 737 - DNA, 263 bp, Homo sapiens
  Genbank Accession No. AA328684
aggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacact

SEQ ID NO: 738 - DNA, 160 bp, Homo sapiens
  Genbank Accession No. AA328993
  unsure (1)..(160): n = a or c or g or t
gctttagagcagttatgggagttatagattataacatattagtgatttgtgaaacttttttactaaaatgtgaccctcattttnctttacatgaaagaacatagaatatttcacaatgcatcccacgtggtaagaataaaaaattgttttagttatatgt

SEQ ID NO: 739 - DNA, 245 bp, Homo sapiens
  Genbank Accession No. AA331393
  unsure (1)..(245): n = a or c or g or t
agaaaaggtggaaatggccttttatttaaatatgaggaaaaaattagaattaagtacagnaagattatttttaaaaaagcagacaagttagaacaaacattttattattaaaataaacttttgtataaaagcattacagatcaaaagctgtatttacacttatcgnttcaaggtccaattatgcatcaaacattgaatggcacagcaatggtttacatatgcaagtaaattggacatacaaacac

SEQ ID NO: 740 - DNA, 233 bp, Homo sapiens
  Genbank Accession No. AA335091
  unsure (1)..(233): n = a or c or g or t
gagtgtggggtcagtttattgggcatgcgtcagtcagaggctgggctggccagggtcgggtagggcagcagtttgtctggaccccgagaaacccaactggaatccagggcctcatctgnttcaaagccaaagtcttcctcaaccttaatctgcaccggggccagctctggagtcagcgcatttcctgctcggcgtccatcccgtggnactcgccgcctcttccgcccacttgg

SEQ ID NO: 741 - DNA, 299 bp, Homo sapiens
  Genbank Accession No. AA335191
  unsure (1)..(299): n = a or c or g or t
gcaggccaaaaccntagtttatttcagcatcagcagtatcttagccatcaaaaaaataaactntaccaagggtgacggaagtntctacagcaaggntaagggctcgccagacggcgaacatcaggggtgcatggtgggcactgcccaggcaataagtnaggaagcagcagggctggtntcgggtgtgggccgggcttnatttctgggcaggcatgaggtcgtcgatggcctggccctgctccagccgctgctccatctcgatgagcagcttcactccgtccaccaccatcttgcaccag

SEQ ID NO: 742 - DNA, 219 bp, Homo sapiens
  Genbank Accession No. AA338512
  unsure (1)..(219): n = a or c or g or t
ccccngtagagataggggtcttgctatgttgcccaggctgatttcaaactcctggtctcaagcgatcttcgtgcctcgcccttccaaagtactggcattaccggcataagtnactgngcctgccccatcccctgaaacttctaacgctagagacttctaaggtgagcaggtggcccctgggacaggaatgcaataataaaatagaaaagacggcaaact

SEQ ID NO: 743 - DNA, 218 bp, Homo sapiens
  Genbank Accession No. AA338729
  unsure (1)..(218): n = a or c or g or t
gccagggaagancagctttaatgccagtaatgtcagccaggagatgggagaccagtctcaaatccatctctccaattgactaaagttaggggtttatatagtagggaaggaacgtaaaacaaganttagggaggagtaaggaagaggagttggtcaacgggcagcaggtggttggatgaggggtctggtgtctcaccgtaaccatatgcaggaaaaca

SEQ ID NO: 744 - DNA, 207 bp, Homo sapiens
  Genbank Accession No. AA338760
  unsure (1)..(207): n = a or c or g or t
gtggaagaatacagaaatatgtttaatacttagtatcaaactaaaaagtaatataaaattacaaaacttcttttttttcatgcacaggcttttnctggtaaggaccgctgggattgaacagaagcttccggtaaataagggccccgtcggcaagacagcatactgctgtcacaagtgcaaacacccctccaccaactgtcaatgttg

SEQ ID NO: 745 - DNA, 251 bp, Homo sapiens
  Genbank Accession No. AA338889
  unsure (1)..(251): n = a or c or g or t
cctcatgcagccccaaagggcannaaagagactttaattaggggagggaggntccaccagantcagaaaagggacagctagcgtgggagcagaggagccagaacaggcaggaggagggcccggccaggaagctctggaggactcacctcgccacctctggcacaggcactggcactnacggacaaggcgaaacagcggcccctctcaactnggagggcacccaatggcccctgtagccagaggttgcccgg

SEQ ID NO: 746 - DNA, 310 bp, Homo sapiens
  Genbank Accession No. AA342301
  unsure (1)..(310): n = a or c or g or t
aaagagatggggtttcaccatgttgtccaggctggtcttgaactcctgggttcaagcagtctatctgccttagccacccaaagtgctgggattacaggtgtgagacaccatacctagccaagttaatttttttaatggtgaaatcttttctttgcacataaaatgagccagtgcatgttgcttctctgagtacaagacaaaatttatggcaatgggcaattagacttatacttttctgcaagaaaattaacgggaaaattctcctcttagttttctgttgttttnccattgatctgatactgtactcgtg

SEQ ID NO: 747 - DNA, 359 bp, Homo sapiens
  Genbank Accession No. AA342337
  unsure (1)..(359): n = a or c or g or t
agagataaccagtttattttggggagcaaagagaaagggtccctaaccccagactgcctgcgaagaggtgaaatggaattgaatgggattatggtcagccaaggcttcctagtggagctgctacctganctgagttttaagaggggtaggaaagaaaaaatgtagtgggtcataatggcattccagatacaggggacacaaacagctctgtgtttatgaactacaaccagttgttgacttttgtttcaagtggctccccttccccagtgctgtgtggacgatggactgaagaggagaaggctgggagcaagggaccagtaagctgttgcagcagtgcaggtgagatatgaggcctcaac

SEQ ID NO: 748 - DNA, 322 bp, Homo sapiens
  Genbank Accession No. AA342446
aatgtcctagcttggtttggtcttgaaaagattcataatcactccaaatgaaatgctcctcccttggccaccaatgtgaagggagggtagaaacctgaggctagacttctgacacaagaagaatctgtcgagagcacagtctcccagtcaataagaaggaaggagagagggggatgagctcgcacccttgagaagaaccttcatgagccaattcccaaagcatcaactccgcatggatactttgcacacacatcagccgtgtctaatggacacacacacgtgcatacacacgtgagcacacgccgggaccacagacccttat

SEQ ID NO: 749 - DNA, 377 bp, Homo sapiens
  Genbank Accession No. AA342771
  unsure (1)..(377): n = a or c or g or t
attgaggtagaactttatgccaagtaccgagtaaagcactggggacattaagatgaactaggcagtctctgccctcaaagaccatcaatagacattttagtatatgcagggagttctggtcacacagaggacaaatggctggaaataaaagttaccaaaatttggcagaaattcttccagatatctttttatgcatacaagtatgtncaagcacacgccaaacacagatacacacataacagatgcatgcatgtntgagtgtgtgtgcatagatgattagacagatagatagcatcataccatctttgatgatcagaaatggtttttttctgcacaatataacatgggcattgctccacaaaaaccaataaatgtag

SEQ ID NO: 750 - DNA, 354 bp, Homo sapiens
  Genbank Accession No. AA342918
accataattgactttttatttaaaaaattacacggagcaatttccagcttatctttttttataaaagtactgcctatatcaaacattttatatcacgttaattccattgaagagctgcctttttctgttaaggtactgattccaattgatgggatacatgcccttaatacagaaagtttccattatttattcaaatatcaaaattaagattattgagaagtttattgctttatggctgggcaagatgctactagcacattttaggtaaataatattctttattaaaaactatgagggtcattctgtttaaaacttttcaagataattcacggggaaacaggtatatctattcaa

SEQ ID NO: 751 - DNA, 357 bp, Homo sapiens
  Genbank Accession No. AA343142
gaggtggagtctcacgctgttgcccaggctggagtgcagtgttgagatcttggctcaatgcaatctccacctcacaggtagctgggactacaggcacctgccaccacgcctggctaatttttgtatttttagtagagatggggtttcaccatattggtcaggctggtcttgaactcctgaccttgtgaccgcccgcctcggcctcccaaagtgttgggattatagtcgtgagccaccgtgcccgtcctagagtcagattttaaatcttcaaatattcaagaccggtttattagctatttgagggttgtgaacgctttctccttccttacaagtgcaaagcctaactcattgaatgtg

SEQ ID NO: 752 - DNA, 291 bp, Homo sapiens
  Genbank Accession No. AA344866
  unsure (1)..(291): n = a or c or g or t
ggggtctgagacatttaataagtaggtaccactccacccactgtcctctggggcagccggcagaagatcccctgccctgggtggcagggccctgatctgaggctggtttcacggaggacaggcagcgggcacccccactggtggggtcgtctctcggggcactgacttctcagcactggagctgtgtnccggcctcacctcctcacttcgtccaggacgtggaactggtctncaagcctcgcagaagccgtacttngggaagtagaagatcttngtcctcagtcaggtggg

SEQ ID NO: 753 - DNA, 189 bp, Homo sapiens
  Genbank Accession No. AA347674
  unsure (1)..(189): n = a or c or g or t
gttcagggcagcctcactggttgacataataacattttatnaaagataatacgnttttaaaaaatcaaatctgccaaacccggaccaccctggaattgctagcacgcctacagggattttnggttacagaaaggcatgcccaagattcaggagagcagagacatctgagcttgtaaatagaataaaagg

SEQ ID NO: 754 - DNA, 155 bp, Homo sapiens
  Genbank Accession No. AA347717
  unsure (1)..(155): n = a or c or g or t
caaatattgctaatttattccttttgttagattcactaatttttaacattaaaaatgacttgtacactttacaaattaaaacattagatcacaaatgaaaatatgctccagacatctataggcatctgcttttctttatactcnactanatacat

SEQ ID NO: 755 - DNA, 389 bp, Homo sapiens
  Genbank Accession No. AA348284
  unsure (1)..(389): n = a or c or g or t
ctgtttgttttttattgaggctcattgaccagggaaacataaatgtnccactcatctgcttttaaagtagagaacaaggcccacaaactctatttaataaatacaaattactaaaaatgcgcttagtgttgtattgtggccagttaagaacaggagatgctgggacagagcctacagaaagggcgggagaagaaaggaaatcaaaatgaagcagctgacagggacgtcagggagacacacaggtgcagtgacagccacactgcagcagaagctcagcttggaagacagaggctgcagaaagtcggtccctctaggatgccaccaggggaaaagtcttcaaaatgttgttgttactntgaccnagggcagaagtcttaggcatcttaatt

SEQ ID NO: 756 - DNA, 267 bp, Homo sapiens
  Genbank Accession No. AA348466
  unsure (1)..(267): n = a or c or g or t
gcaaaatgcagtgtaccttaaaagtgtctcacctagaaggcctctacctgtaatcacattaatttttctaaagacaatttggtgttttgaagataaatgtcattagtctatgataatagcatcataggacaattagccattttagacttgaccatatttnctctttttagcatatagccatcttgatatttaggtgggagactactccaatggagcaacagtttcattttacatgattggatttagaaatttacaaattttaaactc

SEQ ID NO: 757 - DNA, 171 bp, Homo sapiens
  Genbank Accession No. AA348485
  unsure (1)..(171): n = a or c or g or t
aaaatttaagccaactcttattcaactttnctncttcacagcagctgtttatagatagtagggagccaagaatgaaggacagtaacagatggaaagcaaaaagtacaacagctatcttaagtncagctctcaacattgctggttgagtttggaaccaaaacctcttaacaa

SEQ ID NO: 758 - DNA, 342 bp, Homo sapiens
  Genbank Accession No. AA348922
agctttaaagaaatgcttgcctgagagtttattttttggggaaaaaggcaagttaatcccaacatgatcttttgatatgaaaaccacattaaaaatctgttggcctttacacagagtgagtggttcagtgaagataaagtagacagttattcaggcgtcacagctgagcatggctgatccaggtaactctttcttgaaatgcttgtcttcactatagaatctaaggcagatttttaaataacccctgaaaaaggatggagtcggggaatcaggcctggagaaccgagtccaagagcattctgccatgaaagagaatccacgcgttctgatgagcacccattt

SEQ ID NO: 759 - DNA, 382 bp, Homo sapiens
  Genbank Accession No. AA349792
  unsure (1)..(382): n = a or c or g or t
aactacaaaaataagcactttactaacaacaggattctcagggaatgggggctttcagaggtgtcactgggctgcactgttgaggctgtgtgcatcagtggagatgtgagaccgaaagaaattatccaggacttgctggcccatgcggggctttttccgactgcacggagaggacacctgggaccttttggaacccatacaggtccctggctgttggccctgatacacacggaaaacctttttcatggcggtggaaacagctgcggtgtgaaattcctcctgcgtcancagcgagcacctggtggtacggtggtcactngggtctncccttccaaggccagcccatatacttgatatgtcaacttgatgtgagagaaggtgt

SEQ ID NO: 760 - DNA, 312 bp, Homo sapiens
  Genbank Accession No. AA349836
  unsure (1)..(312): n = a or c or g or t
cccaattttgtgccaagatgagaatcacatttattgaagttacattacagaagatagtgaaggggaaagattgagaacttccttagtacacccttactccaatatttnctattagcactgcacatgtattactgcctagtgtccattggcatagaagcctaaganctgcttatgtngccagtcttagacaaggataagcatttttaacaaatacaggtaaaatctcatttgtngctgcaatcttttcacaataaagttaagctgtgtcattaagaaccaacagcgtggccgggcgtgatggctcatgcctgt

SEQ ID NO: 761 - DNA, 230 bp, Homo sapiens
  Genbank Accession No. AA363203
  unsure (1)..(230): n = a or c or g or t
agtactcaaacaactttatttcactagccatgagcaaaaagttgaccggctccaggggattttccatcctgccctctccctgctggtggctcccatgatttggaaataaccncatgttccacttggcagtgcctggntttgtgcacccacanggttttggcctgggncccagtgaaaatggtcctcacctggctggggaacanggttntgagaggccccttgatctgccc

SEQ ID NO: 762 - DNA, 169 bp, Homo sapiens
  Genbank Accession No. AA364267
  unsure (1)..(169): n = a or c or g or t
cccagctgccccagccctggtctntggcgcatcttttccctcttgtcccgaagatctgcgcctctagtgccttttaaggggttcccatcatccctccctgatattgtattgaaaatattatgcacactgttcatgcttctactaatcaataaacgctttatttaaagcc

SEQ ID NO: 763 - DNA, 399 bp, Homo sapiens
  Genbank Accession No. AA365691
  unsure (1)..(399): n = a or c or g or t
ctggaaagcaactgtgtatttacacaacagtggacgcctttnacattgcagaggggcgggtaagagcgggatggctaggaagctacagcacctatttggttatgaacacagcattttcagatggctgggggaatagatgccacttcccactcaagacagggatttgctcagcgggaaagcaggtaataaaggcagcacatcctgcactttgaactgcatccgtctcatcctgcagccaccctgtagctcaaagcacagttctggagcctattaggtccaaatntcaattctacccttgagtcagcgaggccttaggcaagaggtccctcgaagtctgtcttcctgtggcagattagggncggccacaccacaaggcagtcgcttgggcccggggcccgt

SEQ ID NO: 764 - DNA, 340 bp, Homo sapiens
  Genbank Accession No. AA365708
  unsure (1)..(340): n = a or c or g or t
gttgtgtgattcttttatttcttgacatgcacacatatatggntcaaaaagtatgtacaactagaaaaacggactccaagcaaaaatggaaaacatgtttccatgagcttagatttccgggtatattactcctaaacctaaggtagaagtaatgcattgtncacttacatgtccacttttctaacccaagctaagggctggaaaaagaaagtcagaacagtcccaagtaaatatgggaaaccatagcagtgataaaacctaagntttctcagaaatagttttaagtgggaagcctctaatcctacctggacagtgctttcctgtggggtttctcagcatg

SEQ ID NO: 765 - DNA, 214 bp, Homo sapiens
  Genbank Accession No. AA365742
  unsure (1)..(214): n = a or c or g or t
aagatatttgattatcttaaaaattgttaaataccgttttcatgaaagtnctcagtattgtaacagcaacttgtcaaacctaagcatatttgantatgatctcccataatttgaaattgaaatcgtattgtgtggctctgtatattctgttaaaaaattaaaggacagaaacctttctttgtgtatgcatgtttgaattaaaagaaagtaatgg

SEQ ID NO: 766 - DNA, 228 bp, Homo sapiens
  Genbank Accession No. AA370163
  unsure (1)..(228): n = a or c or g or t
gaaaagaaatctatttttaatggctttggctttatagcacgaagcaggcacccnctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctaaagg

SEQ ID NO: 767 - DNA, 244 bp, Homo sapiens
  Genbank Accession No. AA370359
  unsure (1)..(244): n = a or c or g or t
ggttcctttaagcttatttaatatttgaaatcttatttnctatttncccagaccccagaaaacagaaagtttttagatgaccaatattttgttccagaaacatacagccttatcagctaattgcataaaagagcctattttacaaaggtacatctggataattaggaacaataaagtncttttagggcatttgcaaaatgtggatcagtaaaaatacatggattattcaataaagtttttttaa

SEQ ID NO: 768 - DNA, 377 bp, Homo sapiens
  Genbank Accession No. AA372018
  unsure (1)..(377): n = a or c or g or t
gagattaaacaggcaagttttattatcaaatgttaactctacaaaaactcagtagtattgtagtaagcattactgcctatcttaaagtctttcagagctttgggcagctttgggcatcttaaggcatcaagtatacagaaatttcttttcgatcttaagtgccagttatcaccaattttcacacaaacctttttttttttcttcctattgcagttaaagggccattgccagtcagctgaagaaggaaatgtttgcttctccctttaaggtgttaaagtaatgcacagaaaataaaaatagcagcctcataaatctgcacggcattgcattcaagcaaagggncaatatgagtaacttaggggaaatatccacattca

SEQ ID NO: 769 - DNA, 281 bp, Homo sapiens
  Genbank Accession No. AA372630
  unsure (1)..(281): n = a or c or g or t
ggcacatttttgcctttgtttaagcctggaacttgtaagaaaatgaaaatttaatttttttttctaggacgagctatagaaaagctattgagagtatctagttaatcagtgcagtagttggaaaccttgctggtgtatgtnatgtgcttctgtgcttttnaatgactttatcatctagtctttgtctattttncctttgatgttcaagtcctagtctataggattggcagtttaaatgctttgactcccccttttaaaataaatgattaaaatgtgctttg

SEQ ID NO: 770 - DNA, 306 bp, Homo sapiens
  Genbank Accession No. AA376875
  unsure (1)..(306): n = a or c or g or t
ggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggncataaatcttccaaagttttgcctatcctaagagctgcatttttctactgctctttaccttgcattttagctaatttaggag

SEQ ID NO: 771 - DNA, 249 bp, Homo sapiens
  Genbank Accession No. AA377087
  unsure (1)..(249): n = a or c or g or t
acggcacaacttgctatttttattagaggtattgatgatgaatataatgtcactgaagaaatcgaaatgtcaccatgctattaaaagacacaactaaatcaagngatttatatgaagcagtgaaaaatatgttaaagcaattttctttggcctttgtaaacatatgtgntataggctacagatgctnccctgggcgatggtaggtaaaaagagaggggcttntacaatttaataggatgatgcaggttt

SEQ ID NO: 772 - DNA, 156 bp, Homo sapiens
  Genbank Accession No. AA381125
ctgatgtggtggtaactttttgagggataatgaaattatgttcagcctcaaaaccctgaaaattaattataatgctgctcagtcttgcttatgcatttgtttgctctaacatgctctttccattaaaaattgttaacttcctccattgctgttaaa

SEQ ID NO: 773 - DNA, 161 bp, Homo sapiens
  Genbank Accession No. AA382975
  unsure (1)..(161): n = a or c or g or t
aaaagtggaacaaatttatttaatgtaagttttatgtgacacaggagccttcactcaaaaaccgagtgaaaactacttttgtggttaggtttaatgaaatgnatggggcagttgtatagaagtatgattgtancaaaaaagggcatgatggtcctcaatgg

SEQ ID NO: 774 - DNA, 282 bp, Homo sapiens
  Genbank Accession No. AA384184
  unsure (1)..(282): n = a or c or g or t
cttcattggcccagcttggcgaaagcnaggcacactgcttactgccttggggttgtggagatggacccgtgacctcgtggaggccgtgtgggggcagcagcctggcctgtgccatggtgggtgtcctggggcctgtgcggagggagccacctcaccctgcagcccagtttgcaggtgtggccttgtttctccttgcccagcagtgctgccttcagcggccgtgacggggccagctggacacacggtgagattttntcgtatgtaaataaaaggnattttggt

SEQ ID NO: 775 - DNA, 472 bp, Homo sapiens
  Genbank Accession No. AA393139
gacgcgcggggccacactgccgccccctagactggcgctgggactgtgggacaagttggctgggtccgggcttggggactgcaaccggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaact

SEQ ID NO: 776 - DNA, 385 bp, Homo sapiens
  Genbank Accession No. AA393825
ttttttaaagttaaacttttaaagttaaaagtgaaatttattacaatacaataaatgcaagtgtcattattaaaaatgccggttaaaattataaagtatctaaataatttttctaatataaatattggaaatgacaactttaacaattctatatgtacacaggacactgaaaacataaaatcatgaacaaggccaaaaaataacgttgcacattaaccctttagttattactttctattttccagtcccagcatcatacctgctaattactcagatcacaagcctcaaggattaagtgttttgaatgtatttcagtttcatactttaacaatgcttaaagactattggttgtattctgatcaaatggttctccttcccatatttc

SEQ ID NO: 777 - DNA, 427 bp, Homo sapiens
  Genbank Accession No. AA393961
gactggttaaaaacttgtgtatcccgggaaggacctgcggtacaggagtcagccatgtctgtgctgtgtggaacacctgatgacatggttaacgaggaagacgatgtgttgaccggctgccgtttgaggactttggtcacccagactagacaccttctgtgctcatgtttggaaagctgaaagggaaggacagctgtgcctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgtt

SEQ ID NO: 778 - DNA, 313 bp, Homo sapiens
  Genbank Accession No. AA394121
tacaaagatttattacagcacgggaggggttcaggcctggagtcagggaagaaggggaaaggggcagagcagctgggggacaaggaaaacctggcgccccccgctgtgtgccccaccggggacataaactaggcggcattcctggcatcaaagcacaaaacgcaacaaagaggtctctgccagtccatcttccaggcacccaggaggagcaagggtgattaagggaagattcccaaaatgttgaggctatggagaaaaacgccttagtcctggaccctggtagaagccggtgagagaagtggtgacttggaat

SEQ ID NO: 779 - DNA, 114 bp, Homo sapiens
  Genbank Accession No. AA394258
ttcttttttttaagcttccacctcagtgttttactgagaccagcattggggcatatgaggcacaaggaatccagctctgttccctagaagccatccacaaggttttccttgtag

SEQ ID NO: 780 - DNA, 437 bp, Homo sapiens
  Genbank Accession No. AA397841
atttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaatttttttttgaatgtgtggaagtaattttagtataattagattttttccatatttttgaaagatttttcagatgtgaacattaaaataggga

SEQ ID NO: 781 - DNA, 401 bp, Homo sapiens
  Genbank Accession No. AA397904
ttttttttttgttggttcatcacaaccttttatttcacaatattaatagtaatcattatagctaccatgtattaagccttcaccatggggctgttaagtcttcattgcttagctttactaaactagataatgtgtttgcttatctcatggatttctcttaaccatcccctgagatccccctatagttcttatccctttacccccattttacagaagaggaaaactgaggctcagagaaggggagtcacttggccacagtcgcacagttggaaagtggtagagccaggatgagacgctaattctgactccaaagctagttatatataataatagcacccaagtaatgtatagattaccatgttttcacatatggcaaattaaggaatcagaatgaatgatgc

SEQ ID NO: 782 - DNA, 453 bp, Homo sapiens
  Genbank Accession No. AA397906
tttacatatcagtctattttttattataaacaaataaaagattaaatcacacatcaaagacctagactccttctctgagacaccaaaggcctaacaaccagtaagataattttagacaattctattgaaagttattcaaaaggcatcaagtcaaaataacgaaactgccccagtaaaaaggggctgggcctgggggcaggaaaggcaagcatgagggcccagtagaggtggacctgtcccaatggtaactgagctcggctttaaggccaggcattggggatcagctgctaggagcccacctgtgttcttcctgaggggtgggggcacctagtcactgcctagaggacatggtcccccaccagcctacagcatggaaacacccaatgtctgctctagcctattcttaacccacaactgggatgggagctggggacaggagaaggggtcatgggg

SEQ ID NO: 783 - DNA, 327 bp, Homo sapiens
  Genbank Accession No. AA397914
tttttttttgagctcagagccttctttattatttgcttcacgacagagcaaaggactgcagcaggttgactgatataaaagttttaccatgtctcacagcaggcctttgctcaagtttccagtaaggatattgtatcatttcttgcctgcagtacttgtaaatccacttacactgcctgctgttgagtcatttgtttcgtcttgagtagcatgtcatccttgttcctagaagatagtgagtttagagacagtagccaagcaacagcagagcagcctcaaccaaaacgattttccattttggtgggatgaattgaaacacaagcatct

SEQ ID NO: 784 - DNA, 388 bp, Homo sapiens
  Genbank Accession No. AA397916
tttttttttttttttttttgcatttcaaatattttaatagttttatttcgcaaagagaagcctaagaatttttttaaaaacatttccagagagaacactttataccataaaataaacttgtataatttgggaggacaaatcatctcaaatgtatatttttgaattatgtgccaattttataattagtacaaaaatgacagctgaaatattttaaaaatgtaaaaaccagtccaggcaacataactataccatcttgctgtaaaagtacttatatcgaattccgcacaaaatatttttgcaatatgctaaatttagttcttcaagtcactcttcactgccggctggcttttccattttctgttgtctccatcccattttcctctttaag

SEQ ID NO: 785 - DNA, 440 bp, Homo sapiens
  Genbank Accession No. AA397919
ttttctgtttaagaacagctggtttattcttttgatttattgtaggtattaaaagtttcttttgtgagatggcacataggcaggtttggtgtttcctaacactatgaatatcttaaattgcttttgaaagttttatccacaaagaaagaaaaataagggtttcctcacagttgaaaatagtttttgaaaaaaggttaagaggaaaaaaatctaaataccatccttgataaagaaatggaacttcaagttaaaaatacaaatttaaatgaagttttataaaatattaaaaactagctaaaagtacatgcataggcatttaatcaaggtaagaggaacagcagtggaacttaaatatgatacaatttatcaacaataaataaacatttcagtgcaaatagtgcagaaaaatttctcaaagatcatagcaatcattctaatcg

SEQ ID NO: 786 - DNA, 388 bp, Homo sapiens
  Genbank Accession No. AA398102
tttttaatctagtggttctttatttataacgtaggctgaagcaattgttacaatgtaggagggagacacattacacaattgttatttatacaagtttagaacaaaaaactgcacagggagaggtcaactctcagtacaaactagcaactaaagcacaataatttactgttagaaacgatttctttctttttagctgtgacactgcttttacaatatgcaaaaacacaagcagaactacccaaggtgtgttgtcacattctttctacattgaatttggcaacattttatttattcagattatactaacgtttaaaaactaaacaagtgaaaagctgtaccaaggtacagttacatccatttatttcaaaggtttagaataccactttta

SEQ ID NO: 787 - DNA, 519 bp, Homo sapiens
  Genbank Accession No. AA398124
tttcctaaggtttaattttaactaatgaattttaaatgatgaatgtaaagtcaatccaagtctttgcttatttgcaatgcacaaactatttttttgtaacttgcaggtgaaatacattcttttcacatgataatgttttcgcccttatttatggtcttttattatttttcttgagtccttttccttcaatagtttaataagtcacttctggcttgtctagagagcaatcctagcacaataatgtttcaacttgcaaggaagaacgcccttattgagttgatagaactccaccagctgtattagatctgtaaatcttgtgtggccatcatccagtgtgtggaacatttcaccgtcatcttctactggtataatttgaaagtgctttattttttgtccatgactcattgacagtacgaaagttttggggttactctgactatcccgtaccaagaaaactccatccacaagtccttgctgaattatcaatcgctgagcctcatctcctagaattttgtggtg

SEQ ID NO: 788 - DNA, 364 bp, Homo sapiens
  Genbank Accession No. AA398141
ttttctgagagtcatttatttcttttgtcattgccaaacattccccaggtcttactcaccagaaattaacatagcttcttcatttctcctccctgacaaccctcatctactgaaagggctttaagggcacactgccaatgaaaatgcagagtgcatataccatgtccttaacttgtttcaaaactacctattctggcagtatccaattcaggtttcagtgctcccttgtttgaaagtggtcttcacaaaagcccacattttaaagctatttggaggagcacaaagagttaaagtggtaatagcctttcagaatttgaaaaggtagtacttgtctatatcaggttcattttttatgtggcatatg

SEQ ID NO: 789 - DNA, 451 bp, Homo sapiens
  Genbank Accession No. AA398205
tttcagttttttaaaaaagcaaagtttgttaatatttattatcttatttttagaacagaaataacattaaaatagatgtttttagaatatcaacatacaatcaaaaacacaaagtccaaggatcctccccatctccaaggcttaaagggcagctatccagctgtagtctattttcctaaattttctcagttctttttcttcagattttgacaactgatgtataatgtcttctcctaaacctgtgttacttgtatcctggactttttcggtaaaatcattttcttcatctgaatcttcactttctttttcttcttccatatctacatcttcaggaatttccttagcactcttagtctctttagacagcagcaatgaatttacaaacatggagcacaggaaagcagcagatggcaggacatgggctggagtgtgaagaagctcactaattgcg

SEQ ID NO: 790 - DNA, 455 bp, Homo sapiens
  Genbank Accession No. AA398221
ttttttttttaacaaatcacatctggtcttgtttttctgcagacacaggcaccaggggagggaacgaggcagacacaaacatgcgacaggcaggccgtgtgcccgagggcagtcgggctccaaacaccaactctgtccggcgaaaccagggcgcacgtcttcactgcagcggggccacagggcgcccgagcagtggaagtgcacattctgccacttgccgtcgcggcggtgccatacgcgggtctcctcagactggctggtgcggggccggccctgtccgtcaatgtactgcgtgacgcggatgtaagcgatgcaggcggcatcctctccaatgacgtgcacgtgtgggttcaggatggtcgtgtggattggcttgctgttcttggccagcaggttctcgaagtagaatctgtggaagtccatccttcaaccaggttgcccagtgcttcaggctc

SEQ ID NO: 791 - DNA, 498 bp, Homo sapiens
  Genbank Accession No. AA398257
tttttttttttttgaacaggggaagtttaatataaagatgaactctactcggagcatagagtttaaaaagagttctacacaacaccctagggatgaggaagaatgcctcagggaagaaagcacagaaaaggaggtgccctcccgaggctgggactgagacctcctcgctggagaaggtgtgggaggcccctgagggtgaagttccccgggttgctcgagccagagtctgcacagtcacagggcaagcagaaaattctttcgagagggtgggcgctcacagggaatcgggaagcagagcccacctgcctacacctgaaaggccacagccagtgctgggacctctctgaggtctgcagactccaggcagacactcctggcagctgtgcagcaggagcaggaaggaaacgacatgaaagcccctttctccccagtgtcccagttcaacaccgtgcacgctaccaaggagaaacggcgcacgggccccacccacgactgcag

SEQ ID NO: 792 - DNA, 425 bp, Homo sapiens
  Genbank Accession No. AA398280
tttgcgtgggtcattctgatggtggctgctgtcagcctccaagtggcttatgggataggacaaccccccaggcacttcactgtaggacagttagcaccaagagctaaggttgtgagataatgcaaatctggcctgtcacctctgcagagtacaggttcccatactgtgaggcagcagcagcagagggaaccaccagagaaacagcatttcagaattgtctttcctttggtgtatggatatgtgtgtgttctagtctttggtgggcaatggaatctgcagctccatgacaatcttgttaagtagcttatgtgggaagtgtttcaggtcacaagggccacccattctaaggcttctcacttaattccccaggctaagagacaggtggggaaaggaaaaacctagcaccttgctatactgaattggaa

SEQ ID NO: 793 - DNA, 536 bp, Homo sapiens
  Genbank Accession No. AA398386
ttacaggtatcttaactttatttagctctctgtagaattaacatctttgcaaatatattattcaaccaagcatttgccataaagataagcatcaactttcccattggacaagtgatagtgttcaagctacttgacttgtgaaaaacaaaaaaccaccatgacttctcaacaaatacattttaaaatgaaatatgctcaggctgataaacaaacaagatattaaaatggagactgacattgaactacatagtcaacttgaaaaacacaagaagacaatgctcctataaaatgatatattattggctttacaaagacatactggtttatgtttacaactatgttttattttcaaatggtaaaggaaaggcttcatgttgctatttgaaagtacttctcaactagccgggcatggtggcataattcctgaagtaggaggatcatccccttgaggccaggaggtccaggctgcagtgagctgtgattgtgccctgaccatagcttgggtgacagagtgaactctgtctcaaaaaaaaaaa

SEQ ID NO: 794 - DNA, 254 bp, Homo sapiens
  Genbank Accession No. AA398422
ttttttgttgttgcagttgaaagataagccatttattgaccatccacttttcaaataaaacacaaatgtgagcataacataaacacacccaagactcactagcccctgcaagacaggaagcattcttggacagagagtctgcaaatgagtttccttatacctaatgtctgaacttctcactcattctagggtttcatgctttgttatctcttacaaaggaaaggaaactggctagaagattcatgtacaagaag

SEQ ID NO: 795 - DNA, 283 bp, Homo sapiens
  Genbank Accession No. AA398423
ttttcacattttcagacatcatcttgtttattacaaaacttaaaacaccttccaggcaagatccaaagcaattttattctaacattgttcaccttcatctgtagagtcaaatgtatctgccagcttgtgttgacaagggggaatgcttcccatttggtcaaggttgagggacagtaaaggaatcttgtattctaatgagtacagcatcctttcattgtccaagccatccaccttaggctttgaggttcaagtccaggtctggagaagagaaagtttcataccc

SEQ ID NO: 796 - DNA, 546 bp, Homo sapiens
  Genbank Accession No. AA398445
  unsure (1)..(546): n = a or c or g or t
tttttttataaataccatttattataagatagttaccatttattatcaataagcatcatttctcaagccccatgccgggcactaggctgagagctttatgtatgtaatctcatttcatgtctcatttttgacaaagaggaaattgaagtggggacaggacgggtaacttgcctgagaacacacagtaggaagtggcagaaccacttggaacccctgctcttatctgactcaatctccgagtctataccaggaatggggtgggaggccctccagaaccgcagaacctcagtagtgttggagttcgtgttggagcttctcaacaccctggaaacagtgtgttggcacttctcaacacccctcaagtgccatcagtccttggacgnagcggagacaagggccagccacctcaccaaagacctcaaccccagctctcctccacacagacgaaggggttcccagcagggatgtggggtccgagctccctcgctttccctgagcagagtcttcttacctaggtgatgagctcctacatccaaagcgagtttg

SEQ ID NO: 797 - DNA, 506 bp, Homo sapiens
  Genbank Accession No. AA398563
tttttttatatatgtttaaattttaatactcaagaaaacaaacctaagttaaaattggatacaaatactgctggcataagaaaatatacacaaatttggattcaaatggggttattatgtgaacctggatgtaagactacatcctaacaacctgttgttgaagccttttaataaagtaacagattttaaatcagatagatataaaaagactgaagaaaaacagtaacttttccttaagttctcttatccataaagaatgacaaactccatatggacagtaaagttagaggtcatccaatttaccaaggcattttgaacacataaaccttaaatacctactttaagcccaaacaaggtaaaaataatcggcatttcattgtgctccgaagtttaattttacatatcatgttaacaaattatagaaaataaaataaaagcattttccatttttttgaaagtacacatcattacttctcccaggtacttcagtaatttaagcttaatac

SEQ ID NO: 798 - DNA, 524 bp, Homo sapiens
  Genbank Accession No. AA398674
tttttttttccagctcgtgcatcctcctttttatttcaagaggtgccagctccaaacaaagttacaaggttaagtgcaactccaagttcctgacacagctaatccctgctcggtcttcaaaaaatagaggtctgtaattcctttttgaacatgccttcgaagtggaggtctttggccatgagctcttcttcgacatcatctagtgcccactggtgatccgtcagctccaaagcttcccactctgtcttgaaagctttgtttgtgtctgcgggcatggccatggctgctcccgtcatctgctcctgcatcattcgtgattggtcagcggcattatcttggcccagaatcagagagtaaatgctccgaagcccaaatacattgaggaagtaccaggatgcagaactcacccaggatgcatctaatgtgagtagctcgattccttgctgtaacataggcttaaaacggagggtcagtggaaatgggagcttggttgtgacaaagcctgagaatgtcatgttgatcca

SEQ ID NO: 799 - DNA, 376 bp, Homo sapiens
  Genbank Accession No. AA398761
ttttacagttttgtttgtttaatggataattctattagtttggtcaaaagtataattttgctttctctctatgtggaaattaaatacagtcctgacaaatgtacatgatttccaagttggtagaggttgagttctgttggattatgatatgtcaagttggctaaggctgggagctgttttccagaatttccttccctacgtggttcctgggtagagttgaccatgaagaaaggtgttatactcagtcattgccatcagtcgcagtgatggacagatgcagagggacccagcctgctgcagctgatccttgatctccaccactgtgtgtccatcccatctttcttaccgcagcctgctgacgaaggctggctccaag

SEQ ID NO: 800 - DNA, 387 bp, Homo sapiens
  Genbank Accession No. AA398892
tttaagatagaaaggcagatgatttctttattgtaaagacagcagttacaaaagagaataaatatgacattaggatatatttgttaaaaatacaacaaaaacccctagtatttgtgagcaaccccaagaactcacaagtatgggggataagaacatctacagctggataccctgaaacagatgttagaaactggctaatggtgagtatggccatgactttggggatgtttgaaaggccctggatctgtcacttgggaacgtcagcggtctactgtaatacaatttgcacagagtcagagtgaacaggaacccttttactcattggtatcctaactattctttcgttcttacagtgaagtagtacagtatttaagagtggggaaaagg

SEQ ID NO: 801 - DNA, 449 bp, Homo sapiens
  Genbank Accession No. AA398908
tttccagatttataatttaatggctgtgcagatcccagtccctcatttctgtcgctcacgtgcccactggtctggggtcagggttttctgttcaaaggcatggatgtgcgggactcttctgctaggcacgcgttcaccagcctgtgtctctgaagcagcggtttcccctcgaacttggccgacaccaccaggactcggaagctacaggagcaacggttgagggtcgtgtcctccacctccacatgctccgcctccaggtcccgctgcagcttctcgcggaggtattcggcgctgagttccatggcggcagtccagctggaacggcagcccagcagggacacaaccccagctcgggcgccggcacgctaccttgctgccttacaggagccacttccgctggaaaactcacttccgccttactaaggcgtacgtcaacgcagtacttccgc

SEQ ID NO: 802 - DNA, 303 bp, Homo sapiens
  Genbank Accession No. AA398926
tttttttttttatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattcgctctaatctctctggttttccaaggccttgctcggtggtcctgccgggcgggctctcggg

SEQ ID NO: 803 - DNA, 301 bp, Homo sapiens
  Genbank Accession No. AA399226
ttttttttttttttttttttttttgctgtgaaaatactctgtttattaaagaccaggcggagggaggtaaggttgtgggttctgtatgggaaactgagtcccagccccagggagggagaaggaggacggaccagctggcagccttcgagaggtcacaggtcagtggccggaccccagtcatagccgtcttcatcggaggactccgcatcatgtactcgcataaactttttcttcagggcttcccgttcataggttcgcatgctgtcctgtcgccactgtccctgggggtggcggctgtcca

SEQ ID NO: 804 - DNA, 370 bp, Homo sapiens
  Genbank Accession No. AA399251
ttttttttttttttggtttcttcaaaattttattaacaaaacccagggagaggaggcaaggatgagtggactccgcagccccaccaggcactgaacatgtcgacggggacagtccctctgataaaggcagatgggcggtcaaccggtggatgggcacagggagaaccggagaaacagatgagtggaggaacggacacacgggcaccgggcggctcccccatctggaatgcagggtgtaaggggtccgggccaggaggctcagcggtcggcactggagcgcaggtcggtagtgaggggatcgtgctggatcgtctggtgcagcatcagggccagcaatcccgcgcggtttgtcatggctgtgcgcacattg

SEQ ID NO: 805 - DNA, 482 bp, Homo sapiens
  Genbank Accession No. AA399264
ttttttttttttgacttagaaatttaactttatttacaaatgttctcctataaacaaagatgccattctacacctttaaaatattgtaactgataatttccataaaaaccatttacatagtttcaacctttctgcataaaactgtattatgagataggcaaacaatctcacaagatggtctgagacataaaaacaaaagacaacctatccagcatcaatgtcctattgacaaactcaatgaagaattaagaatcacactccacaatgtgctgctccaccaagaaatagaaatgtaatgattttttgaaaggtaaatgcttcacaataaacagtcttcttgggtagtacagtgtaattgtgattgtttaggactgctcttgtgggctaatatttacgctgttgttttttttaaatcatcattgtaaaaagggcagacttatagatttttctgacaatgaaaatctgtagacactggtctggtc

SEQ ID NO: 806 - DNA, 317 bp, Homo sapiens
  Genbank Accession No. AA400030
aatttgtaagtgaagctgttgctgaacatgaccactatcgttgctgaaatataaaattatactcactgattgtaatggttgaaattttcctgaaatatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgaaaaaaaaaaaaaaa

SEQ ID NO: 807 - DNA, 401 bp, Homo sapiens
  Genbank Accession No. AA400080
tttaagtctgaagacattttatttttcctatgtgggaagcaatgatgatcttacactttttgttttctgtttttaagaagggcagcacaaggatatgtgcagattttcttttaagtaccttgctaagcgacactagactaataaccattttctagaattaggtgacctacttctgaataaaattgaaactggattgcgtattcccttactaataataatactaaatatattcttaaatcagttttcaaaattcaagatgaaatctagaaatatggaacaactagcaggaataagcccgaagatgattctagctccgttactactaaaacctagtttctaaactttcgaggattttatatgaactcgcatgaaaaaatgagctcagaggctagaatatgact

SEQ ID NO: 808 - DNA, 513 bp, Homo sapiens
  Genbank Accession No. AA400177
ctggctttgctggcgaactcctgcacacccttcaaggccctgttcaaatgtctctgtcttaggctgacgcagctgctgcccttctgtggccatacagtgctccttttcacagatgatggctcctgcagggagtgcccccagtgcccagcacagggccaggcacacagtggtgcacgggaacgtctgctgatgcccaccctaaggccaatcaaggagccacggggctgggtcctggtcctcacatcctcttccgcatcttgcccttcttggagcgggcaccccggccgaacgccctgctgcagctcctggacgcggcggcggttgcgggcagagagctgcttgaggccaccacgctgcaggaagtgcagcttctgggcccggcgccgctgcttcaggatctgctgcttggtcttgagttccgggcggactcggcctgcaggggtgcctggggcgtggggccgggatgcaccttggccacggtctcgcttcccacctcttcgctctgggcctcgc

SEQ ID NO: 809 - DNA, 382 bp, Homo sapiens
  Genbank Accession No. AA400184
tttgaatatttatagatttatttataatgaaattatggtctaaatatttacaacatataggaaaccagaggataagtttatacaaagccagcctgcaaagtattcaaatgtgcaaaaatgacagttcaatatctcaaactattcctggttcagcagactagctccttcactttcacacatcaatatttgatacaaaaagttattttggcaaaatctgtaatgccaagaaaaaggacaatttgcaatttcagtcattaagtccaaaatcctatagccagcagtcagatctctctgttttagctgcaaccagttctgggagagagagaccactgtatttcatttctgtgatgagttctgaccagttttagtcaagaagttttct

SEQ ID NO: 810 - DNA, 438 bp, Homo sapiens
  Genbank Accession No. AA400246
ttttatttttttttcgtaaaaactctaagtcaaattactgataaaattgcaaaatgagcacaggttcaagagcaccttgctcacttctctccacagcctcccaacctcccagcctctcccactctggggtggccagaaccaaggcagaattcagtcactgatgcagttccaggctccatgcagctgaggaggagaggaggcagatgtggacagttctgtctcttcgtttaaaaaatatattcctgtagagagttattgcttgtcctcccgtgggcaggagggcgcggtggctcagtgggccagagccgcagcctccagggcccgagctttcttccgcctcttcagcagcagagggttggatgcatcttcaatcttttttatcttgatctgctcgtagtcaacgcgcattgtggccaaggcactggtcatttccagctt

SEQ ID NO: 811 - DNA, 400 bp, Homo sapiens
  Genbank Accession No. AA400251
tttttgctgtataatacttttattaaagttttatggaaaaaacccacaacatttctgtatgtatcatatcatataatttccaggtgtgtcagagtccagtgacaaattacgtttgaagaacagctttaaaatccactcttgtctgccactcctttatgaaatattgaaaagcagctctgtacctcagcattaaaggttacaaaaagcaccattaaaaagaggactcacatatttaatccccttcaaagtagtcttatctctcctttctgacagacacagagctgcactcattcgaaatgctgccgtgtaataccaaccaacatgctccaatgtaccaaaattcaaacaagtctcatttatgagacccgtgtagtgattaggactaaccaacaacagtgag

SEQ ID NO: 812 - DNA, 411 bp, Homo sapiens
  Genbank Accession No. AA400258
gagagttcaactattttattttgcaatctaagggatttttctctgcacttcaatcaaactggaaaattgagaaccatttgctcctatgtaacctctgctgaaccatgaccccaaggtctaaggagaaaccacataggataaatgtttacgcttcacgtggccacccagatccatttttgtttttgagtctggcttttctgtggctgaagatataccgcagtcagcaggtaatggctggatttgggcgcctccatttgtttcttctgcttccctaaaaaatttttcatatttgtccaggtatggtggtcgttcaggtagtaggtaataatgtgttgaactaaccttcttcccattttcaataatgggcagaatgaaggaaccttactggcagatccttcgctgttctgtctt

SEQ ID NO: 813 - DNA, 417 bp, Homo sapiens
  Genbank Accession No. AA400259
gttttttttttttttgcctttccaacttttattccttttccgcacagctccttctcattgcagcaatcactttacctgtctttcctgcaatgccaattcattcccacatccctccaagacccaggagagcttggggaagcagggtcagggacagaatccccaaaggtgcacagtcccttgaggaaggtggcaagaggtgtagatcaaagctgagctgggacaaaaggctgctttgagcctctctgggtgagctcttcaggaaccaggaccccagaagggcaagctcctctctccacggccatcgccatggagggatcctccaagctcccactttctgtgatttcagagtccctcagactcggccgatgggtcatttttcttgtatattttctcttgattcccctccttcatggctgc

SEQ ID NO: 814 - DNA, 417 bp, Homo sapiens
  Genbank Accession No. AA400271
aagaaaaacaaaaatttacttcaaattgtagtataggcttttcaatcacaaaaagaaagaaaagaacagtgatctgacagtggtcacatcctgtgcaaaaaacttgatacaaaaatgatagcacatggtatctgagctgcttacattacaagaaaaaggaaatacagtagctgaaatatggcactcctgggaatcaacttctaaaccaaatagaatgcctttgaaatgattaaatttatttgtgtattagtaagaaagccccaccaccataaatagtacaatatttaaaaataaaaaaaaatatatctatctaagatagatagtgtatttgtactgttagacttctttaagtgcagaaggtggttcaggttttgcctttttaattaaataactgaccatgtgctttataaagattca

SEQ ID NO: 815 - DNA, 340 bp, Homo sapiens
  Genbank Accession No. AA400333
aagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaaga

SEQ ID NO: 816 - DNA, 391 bp, Homo sapiens
  Genbank Accession No. AA400471
tttttatttttctgaaatattttatatgaaattaaaagtcttgtagatactaaaaactttggagagtatcggaagagagaatgctggtaatggctcgcactttcttcagcgccagttagagaagggtttggaatgttctctcctgttctgcaggtgtgctccacatccccagccactcaggtccccagaatgcgacaggacctggagggcagcgagctcgtcatccttggtgtttgaatgccatctatctgtcccaacctggtaggccaccttcctcctgggaaaactggaaaaccaaagaattgcttctgatcagatccctgggaagatgttcaccaggatgtaaaacttgtctaaagaggtggggggttcaggctggcactgtggaggc

SEQ ID NO: 817 - DNA, 439 bp, Homo sapiens
  Genbank Accession No. AA400643
ctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagcagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagccctgattctgaagacctgtggcccagcagagcctctgacagtaaa

SEQ ID NO: 818 - DNA, 223 bp, Homo sapiens
  Genbank Accession No. AA400780
atggctcaatgttaattttttaatatacttgcaaatacattataataaaataatacaaccaaatcaaaaagcagccacttaaaaactgaaattcacaaaatgagctgttcttggctacatacagaaggccaacatttaaactgaatgataattaaacgtttactaccataggtaatatttacgcacttctgggtccaatagaaggtgttgaatcaatgtgatc

SEQ ID NO: 819 - DNA, 326 bp, Homo sapiens
  Genbank Accession No. AA400831
gtattgaaaatattttataatcaattctctagaatcctagccatccagtacaggaaaaaattatattggaacacttccgtatttttaaacaatgaaaaaaaatttgactagaggatggcataagaaatttacaaatacaaacttaggcttcctcacatttcccacagagcaactaaacgagaaaaagatttcaagaaatgacagtatacctcgaatgcaaaattccaaagtcaaatagctacttacattaagagatttaccaaaacagtttgtaaattaaacattaacagcaaaaggcacaaaaagcctatttcttttatggtgtc

SEQ ID NO: 820 - DNA, 323 bp, Homo sapiens
  Genbank Accession No. AA400834
aattttgttcatttttattaacataggacatactaaccaaatattatcatttaataaaatcaacgttacaaagaaactcactagcaaataaacaaacgatattcacttgactcttctcttggttgaatgattttctattaattagtagtacacagctatttttatcaatttatgcttaaactgccttatgatttcaatgaaatttcttagcttttacttgttgaataattttttcaattgggaatcttttcataattcaaaatagttcctgaaaattaatgcatccttcaatgtcttctacttaagctgggtgcatttaaaat

SEQ ID NO: 821 - DNA, 332 bp, Homo sapiens
  Genbank Accession No. AA400864
caaatattaagtaaataatttaatgatagaacactgaaatttctttagacacagtattttcaagttatatttctgcctggagtacagatatgaaatagcacaaactgtactctgaattaagcaaacagaatgaataaaaaaaaaatattctcccaacctaagtttccgttcctcatttccacttgcctcagactctttctattgaacatatctagttaaatctctaatggacggcctgtgggaagatttactgccaacagggtatgactgacttctttccggacactgagcaggggactgtgggctctgaagcagtttacttcctgtggaag

SEQ ID NO: 822 - DNA, 421 bp, Homo sapiens
  Genbank Accession No. AA400896
tttgcagcaataaacttgacatgtttattaattaaactatcacttaaataaaaaaaagtgcatagaaaataaacatgtttaaaaactccttttttttacaactatgtacactttttacttttacattcagtctttcgtagagagctttcagcattattattttttgaactattaaagtattttccttcatccctgtcacagggagttaacactgatggactttagacacattttccttttttttttttctctttttctctaaccagaagcttggaagaacacaaggaaaaaaaacagatctgttatacatgataaagttgtcaaaaaatgtcttatttctagaaaagaagcttgtcatctgttgagctcttgaaacaattattcaactacctgtatttactaaagagactgttaaaagttc

SEQ ID NO: 823 - DNA, 461 bp, Homo sapiens
  Genbank Accession No. AA400915
ttttcccttgtttgtttttattgattctttttaagattgaaacagactattacaacaatatttgagatttcacagagaactgcatgcttttgttattaaaagacttttgttgaaaaatttgacctttacctcttatgaacgaaagaaatatagaggtttcaagcatttttgccagcacagagtcattcacaacaaccttctagatgcttattttccaccttttcctacagaaggtaatattcagttaccagaaggccatctccaccactgaatgattcaaagcttcagagctcaaaagtgatcagaactcacaaattagcataattagtccaaagcttgatttaaatgtttgaagaacagcaaacatcaaataatataataccaaatagaatattatagtctctatgaggtaataactcatcagctacaaccacctaaaactgaaattttctgtacttagt

SEQ ID NO: 824 - DNA, 471 bp, Homo sapiens
  Genbank Accession No. AA400934
ttttgcgcatttaaagttgtattttatttttaactatccaatatattaaactttgattacatcaaatgaaatagattgtgcacactcactataagagagctatgatatatgcagaagcaaaggtgcagggatcatgcaatagtttcgtaccagatttcaagataccaagtagcaaggaaacacaatggaattgaaggctgaggtgaagtacaggcataaggcaaggaaagcagaacattcaagatgtacctatatacaccagttcttaaaacacgcaaatcatttccaataaggcactggctcatgtatttctgttgaggcagaagtcaatcttaggatgtggtctgtacatatctgcagataagattcacaaaagctgaattcagtgttattagtccttcattcagatgcttcatttttgcattttcaattgctttcctgtgatataacttatctttatcttggggtcct

SEQ ID NO: 825 - DNA, 355 bp, Homo sapiens
  Genbank Accession No. AA400979
ccagaagtaaggtaactttactcagataaaacacagatggtagcagatagaggccacaagctcatgggatgccattccagagggcccctcacccacagaggagcccctgtaggaaggaggcccaggccccatccgcacagcaagtcccggtgaggggctctaacacacccccactccagcctctggtcatggacacagcccatagcgggcacagcatcatgatggaatggactctgcaggccacgcatggctcctgggaacccccagcccctcccttctcctcccagcctttccagctgtcttcccaccaggagggctcggaggtcacagcacggaacgtcttccaagagcccct

SEQ ID NO: 826 - DNA, 302 bp, Homo sapiens
  Genbank Accession No. AA401091
taaactctgtgcagtttattctcattacagtgttcaaccagtttgacatataaagataacacactttaacagtaaatgttgggaggcacacatatattcccattctgaaagaagacatgttatatatacggaaaaaaatgcagcaaatattaaggtattcaaagtaatttttttgaactcagatgtgacatatttacaagaaaagtgtgtacgttttaaaataattaaataatttccatagacttataaaagaattgagataaatattaggagaccctgacaatcaccagaacattttccta

SEQ ID NO: 827 - DNA, 262 bp, Homo sapiens
  Genbank Accession No. AA401151
ccttcttttacctttatattgatatttaaaagaaaaagaacatgatggatacgggaatgggggaagggacaacggttctacgattaacaacaggaactgataggaaccagaagctccaaggatttaaaaaaaaataaaatatatatttatacatttatatatatatatatatatcacgttatgtatgtgagtcccagacaagcaggaagcagcagcaagaagcaactagcacacagaaacacccgtgcgtgtgcactacaca

SEQ ID NO: 828 - DNA, 411 bp, Homo sapiens
  Genbank Accession No. AA401343
tttagaacagtgagtatttaataaatgttaaccatgcccttgtggtgctggttgacagagaagggagtcatgttttctcaaatctgggaggttggtcatgttggttttggaaacagaaaagttgggctgtctcccaggtggaggtacctttctgagtgtccaaaccctatacccagtggagatggagaaagcttgatgactgagtgaaaatgaaggctagtgtcagatccttcacttgcaacacacaggatgcgcaggtcagaggacttgaaaggccacctccaggcctgtccagagctgatgactccagggctccctctcctggcaccatgctgagaggtggcagccctactgagactctagccagaatcaccttgttgccgtaccaagctggcaggaagtcagaaatcc

SEQ ID NO: 829 - DNA, 391 bp, Homo sapiens
  Genbank Accession No. AA401376
tttttaccaaaatataagcctttattaataaaaatctttggtagtaacagtattttaaattcctctcaacgatatttggttaactaataaactccctccacctttgagctacagaaaaaaaatcctcaatctaccatataattgatatttgaaaaaaaaaacccataaatattctaaagcttccaggggacccctggaagccctaagacttcttgaaaccctgacaccatctgtggaaatgcttccgaggtcatctctctctgcccattttctggtcaaccggttttgtcccataaggaagatgaacaactctgaggtcggcttggtgtgatgggggcaggtgtgtggctgacagtggggagcctgctggggacgccaagggtgctgtttc

SEQ ID NO: 830 - DNA, 266 bp, Homo sapiens
  Genbank Accession No. AA401562
tttctgtgaacacatctgagtttattctgccactgctacagggcccactgtcatttccagcccactgaggttgagggtatggccaggctgggattcacacaggcccaggatgaaagggacaccgagtgtgttggggtgggggtggctggctttgatccctaccccagtgggttggccaggtgatcagagcctccaggttccctcacacacagcctggtacatttctgccgtcagggccggaaggactgggcccggttgtccagtac

SEQ ID NO: 831 - DNA, 516 bp, Homo sapiens
  Genbank Accession No. AA401825
ttgtttttttttttttttttttttagagctgagaataaatcatgtgaaacctgtaacattttatttgttaaaaatgaacagcttcagaatagatctaaatgtaacttttccaaaaaacaccaaaaagtacagtgtaaagcacctcctcgttaaatacaaactttcatttggtgatgcacggcaccaatgttttgcatataccttgatgcaaagaaaagtttaagttgcatcctgtttttaaaaaaaaccgaaacttaagaactgaacaaggattacaaccacattccaaaaagaaaattttccttcaacaaagcatattgttttgtttatatacaatatgtgaccaccaagagttttaatttagttgtaccaaaggcaaaacattatacttaaaattaaattacagatgcatgaagaataaaagtttaatgtatcaaagataatttgttatttaatgcactcaatgtcagtatttggggcaatttttaaagttttcccaaaaaatggcatgaatag

SEQ ID NO: 832 - DNA, 470 bp, Homo sapiens
  Genbank Accession No. AA401958
gagatggagtttcgctcttattgcccaggctggagtgcaatggtgcaatttcggctcacctcaacctccgcctcccggtttcaagagattctcctgcctcagcctcctaagtagctgggattacaggcatacgccaccatgcctggctaattctgtatttttagtagacacggggtttctccatgttggtcaggctggtcttgaactcccgacctcaggtgatccgcccacctcggcttcccaaagtgctgggattacaagcgtgaccactgcgcccagccagtaactgccatttctaaagaggaaagagagcaggcagagggtcctgactcccaggggacaggtagttcagctggacaatgagggagtatgagattagggtggataaggacactgctcaccaccctccactgaagttcagtggctaaaatactgctacaccagccaatcagtggaaggctatcttgctc

SEQ ID NO: 833 - DNA, 378 bp, Homo sapiens
  Genbank Accession No. AA401965
gagagcacaactccaaatcatcttttattaatataaaaagggcatatttagcaaaagacacacagataaaagagtcactatggctcaggacacaaggcagggaggtgccaggcctgtgcccctgctgggggagaaggaggctcgggacaaagtgggagaagtgctgggaagggctgagcggtaggggccacaaaagttccggtgggcaacactgtcggcaggtcatgggtgggactcatggggacctcgctgctaactcttgttgtgggggggtgtccttagtgctgccacctggagggccactccttggttcctggaggggacccaccaagggacacaggacaggaagcccaggatggttagtgcaactcgggatga

SEQ ID NO: 834 - DNA, 417 bp, Homo sapiens
  Genbank Accession No. AA402006
gatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttatgttgtaggctggatgctactcagttcatga

SEQ ID NO: 835 - DNA, 366 bp, Homo sapiens
  Genbank Accession No. AA402095
tgttgctgaccttcacttttatttaaatatagtgatcttttaagagaataaacaaaaaatactttacacagcaaatattttacataaatgtaaacatgcatgtctacttcataattaagcaaaaaaaacttttaggcacaagattttaaaaataaagaatgagacaatgaaaccaagactggaataacagaagtaacaaaaactcacatttcctaactcttcaattggtcttgtcttccaacctattggttaaggcctgagtttcagaaatcctaccttccttgccaaatagaaacatccactttggctgtatataacattatccacataacacactaattctctttcaaaataatgtaataaata

SEQ ID NO: 836 - DNA, 290 bp, Homo sapiens
  Genbank Accession No. AA402224
tttgtttctaaaaagtttattgtaaaattcaaagcttcaacagcagcatcctttagaaaacgaagcattgcccggatccgttttgaaaaagcagcgcagtcggctaagtccttcacgctcctgcaactgtaccaagtccagggcgccgctccttcctgccgagcgcaggctgctgagtcacgcctgcccggccagtctgtccttcctggccctgaggccaacgtcctagcctaggccttcctgggcgagcagccgctccagacacttgcagagtcctcagctcggaccag

SEQ ID NO: 837 - DNA, 359 bp, Homo sapiens
  Genbank Accession No. AA402272
tttttttcaccgtgttcctggagctgcccgctgccctctgccctgtccgtccccggcagagactgggagccggccctcagcatgaccaccgaaactttatttacaacacgaggctggagtaagaggggtgggatggaggacagcagcagggccgacagaccctacttctgctcccgcctccagacgatgaccatgccgctgggttcactggaggccagtaggctctcgtcgcagttgaagctgacatcaagcacaggtgcactgtggccctgcagcttgttgacagcagccttggccgcccgctccacatcaaagaagtgcacgcacatgtcctcactgcccgtcaccacgcaggcccc

SEQ ID NO: 838 - DNA, 236 bp, Homo sapiens
  Genbank Accession No. AA402495
tttttttttttttttttttttttttgcccaccaagagggagtcctttaatagagatcggcacagacaggagacacaacagcccaggcgccctgcttgcacaggctggggccctgagccaacagatgcagtggcttcctcctcccccacctgggtgtgggcccatggggtggagacagagaggtggctttaaaaaacacagctgtactaattcttcactttcacagagaaggggaac

SEQ ID NO: 839 - DNA, 329 bp, Homo sapiens
  Genbank Accession No. AA402610
ttgttttttttaccagatctacttttatttcagaaggaagtttgtattatagtatttacttttgtttatatacaagttcttcacatttgtgtttaaaatgcacagacctcccttagttctcttgttcctgcttaaattagctgttattttacaatacagaaaataccaaaaaattgcagtcctaaatgtatgtataacacccacaatccccgcaatgaaatagtttacaatacttactccatatttacatgagtgtaatagatgctaaattatacatattaacaaactaagcttgaatccaaacgaacgaaatcgtaaataactataaa

SEQ ID NO: 840 - DNA, 150 bp, Homo sapiens
  Genbank Accession No. AA402642
ttctgattctaaaaattatttctttggggttatacattgctcagtggcttggaggtcctgatcagtctgctgaaagaagtggatgcctcagttaatcaggtgttacgggattctggaaagcaccaaatgtggaggcctctaggcaggaag

SEQ ID NO: 841 - DNA, 271 bp, Homo sapiens
  Genbank Accession No. AA402656
ttgtgcttttaaaagtccttttaatacagcatgaagaggctatatttctataggcgagccgtatacagattctccaggaataaggcacacaacggaatgccatcccaagggctgcacttcggagacgtcggagccttctccacgcaccttccgagctgggcccacgggttctgttttgtctttttagctggactcacacgtatggacagacacagacacggacggggtcaccgcatgggggcggaggaggtcggacggcaaggttggcaac

SEQ ID NO: 842 - DNA, 531 bp, Homo sapiens
  Genbank Accession No. AA402799
tactattaaccattgtatatttatttaaaagccataaagaatacgaaaaagcatgaacgcacaaattccagagaatttgttttttaatcaatccgatcaattttacacaacaaaatatcattaagaaacatagaaatcatgtgaattgtattaaaactatgacatatgacaatattatataaagaaaattttaactctaagagacaaatataattttttaaaaaagaaattaaaaatatcacgtcttatgctaaatatatatagatatatttattatgatgcagcaggttttggaatacagggatttaggcaagttaaaaataaaaagtttatatgcttaaactttctgaatattgtttgtctgatttcctatttaaatatcagacatcattataggaaatacatagtctacttacgattgcaatggcactttcaaatataaggcaattaatattttagaaagcagcaacttttactttttttaaaaaaaaaagctagtagcagcatgtaaaaatgagcattacgagaaac

SEQ ID NO: 843 - DNA, 457 bp, Homo sapiens
  Genbank Accession No. AA402937
cctttttctccagttttggaggagaactggaagggagtaaaaagacctgtccacagcacaaacttccactctggctgtgaaggactagccaattgctaaatgtttcatcacggaggtgctcgatcatattatataaaacactgcaacctccttttcattacatccttcatatattatggatccatcatacattttaaacaaattagatgaaaacagctagaaaaagtaaacagaagtttttgagggacagggccatgagagagcagaaacccagggagcaattttaaattaatttgactaaaataaagagtatagtcttgcaaaatgtgtacggaagggagtgggcacatgggaacagggcagagcaacagcagcactcaggatcctttcatcagaaaggggaggcattcaggaagacttcagttgagaaaaaggtgttcaaaagacattcaatgac

SEQ ID NO: 844 - DNA, 418 bp, Homo sapiens
  Genbank Accession No. AA402968
cctgcaaaattcctaagatttattggagactaggcctcttctctggatccacaaccgtgtccagcccagaatcaggacccccaaacgtgtctgggaccctgtccctttcattctggtctagacaagtccccacacgtggccaaaggacagcacccagactctgcccctgaccagtcaatgtgcagcaaacccacttcagtaggcagaagagtctacccctagggagaaggcgccaggagcaggcaggtgggagggaaagtgttcggcagggcagaaaccctgcctggctgtatccaactgtcactcccactggaggcgctgtgtatgcagggcccggcagtaagcccagctgcctacagccaaggcccagcgacagacatcctccttcggtagcagcagcagcctgtcctcctccagc

SEQ ID NO: 845 - DNA, 394 bp, Homo sapiens
  Genbank Accession No. AA403159
tttttcattgtgcaatacacttttattttccttttacctttgcagtcatcttcgagtaatcgttgtgtaaacaatagaatggaatgaaattacattaaattgtatgcaaatggctctagaacaccttaacaattatgacaaggcaattataaataactttttttccttagtaatatatatttgctttttgaagtacattaaagagctgccatatctagggttagctaggaaagagcaatggtaccatcctgggagcccacctccttgaaagattagactccaattttcaaaatcctaaggtttactagttccataatatacagtcaagcagagggctacttgggttgaaagtattgattcttgaaccttaacagcgttttaccttttagtcatt

SEQ ID NO: 846 - DNA, 536 bp, Homo sapiens
  Genbank Accession No. AA404214
agaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggcttt

SEQ ID NO: 847 - DNA, 485 bp, Homo sapiens
  Genbank Accession No. AA404248
tttttggaaccaaaatttgcttttaaaatgtgagtttttaacacttgaaggatttcattcttaactctcaattatataattacaaaaaaaatccaagtttcaggaaaacatacttaatcctaacataaaattcatgtcacttatcacaaagacagtcaagtgtataaaggagaaacaaaacagaagcagtatttacaaatttaaactacatgagatgttgtgaacaatcttttgttaataaacagcacgttacatacttttacatactacatttcaaaaatgcatctgtgaataatatgataaagcgcatagtgttgaagactttaaattaaatccaaggtcatcatgttgaagacctgaaattaaattcaaggttgtagtgatgaaaaatttaaagtcaaggtcttagcgataaagactttaaattcaaagacagattgtctaaggacaaaccactagcgttcaagttgtttagtcaattagtt

SEQ ID NO: 848 - DNA, 579 bp, Homo sapiens
  Genbank Accession No. AA404252
ctgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttctgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacatt

SEQ ID NO: 849 - DNA, 174 bp, Homo sapiens
  Genbank Accession No. AA404338
tttttttttaatataaaaagatcaatgaaaaatttatttataaatttttcacgctgggctacaggtcaatatcgtacactcaggaatgtgctgcacaaactttatccagttagcagtgatcaccccgtgacccacacacagcttcgatataagcctagaaagtcttaacattaa

SEQ ID NO: 850 - DNA, 528 bp, Homo sapiens
  Genbank Accession No. AA404352
ttttttttacaaataataacaaactctttattgtaaatactctttattgtaaatattctatcctaaattccatatagccaattaattcttacagaatcttttgttaatttttgtgtgtataaattttacagagataaagggtatgtttgttgctcacaacttacaaataataataaactctttattgtaaatattctttattgtaaatattctttatcctaaattccatatagccaattgattcttacagaatattttgttaatatttttttttttgccaaaccttgtatccaaagtcaactatcactgcgatttggccatgatttgacaaaattagactacgaataaaaatccctgataactgtacagctaggcactgaagaatgggtataggttcggcatgaatgctggttgaaatttttgtttacactagtgaggaagacaaaagtaaaacaatgaaaatgaatgtcagaactccttcttaaatgatttgagcagctgtcagctgaaacggatgacagtgttcaa

SEQ ID NO: 851 - DNA, 286 bp, Homo sapiens
  Genbank Accession No. AA404487
ttcttttttcagtttaattccatttattattctttaaggatacatacatggagataaagtgatgaaagagaagaaggctatggtcaacacaaagttcagtacaggggttccctctatcagacagggatagagataggttcagcaaaccgcacacggtacctcaggggaaaggcaataaggtgggtggtaggcacacaggggtttgtttattgtcattattattactctttatactttagcatatatattatatgtgtatatacatatctatattccattgcatgta

SEQ ID NO: 852 - DNA, 285 bp, Homo sapiens
  Genbank Accession No. AA404500
ttttttggctttttaaaatttttttattttttcactcatcatttatttacaaatacacattataacttttatatacattgcacatttacatggtagaaaagtacaaaactatatatttaaatgaatttatattttaacttgccatgtttgaaaatataaaattgcatcagaaaaaagtattatgaaaagcaagaaacttgaactgataaagctttgatataacttttagtgatatactggttgaaaaagaactaatttaaaaggtacagctgagtagcttaaagg

SEQ ID NO: 853 - DNA, 267 bp, Homo sapiens
  Genbank Accession No. AA404560
ttttttaaagggaaatcattcatttattaaggatcgcaagacaacatcttaatttctgtagtacgatttaaatgttttacttctttgataaagcagagtacaatagaaaaaaaacaattagtttccagtaatatctatatctctaatcagaattaagtcttccaagacatattacctggaaataaaagcctgttacaataagcaaagcttcaaccagagcggctacttttcgtgccaggaaaaagttcatccctatagggaggaatg

SEQ ID NO: 854 - DNA, 269 bp, Homo sapiens
  Genbank Accession No. AA404597
tttttcccaccagagcctccaaccaagggagctgtttatttgacagggaaggaatttgaggagccgtgttagtcctggcccaggacaggcaggtggaggtggtggcggggggtctctgatgggggcctcaaagactgcctctcccctcataggcggactccccgcggggccacgcttgtgctgcaccttcaggtctcatcgaagtccacgccaccagctggtttcttactcttgaacccggggttgatgagcgactctcctggacaccg

SEQ ID NO: 855 - DNA, 318 bp, Homo sapiens
  Genbank Accession No. AA405098
tttttttttttttttttttttttttcaacttaattttacaagtttattatagctcatacctgggaccgattaaggtgtcaacattttaaaattactcaagatattaaccagaaaagatgattatggcctttaaaactattggacaaactgatgctatttaacattgttcacagccatttaatttgaataacaaattttagattctaagtaggccataacttctttgcaaaacaattgatttataaaggtacagtttcagaaggtaacagcatgagactagtcttcctataggcacattttagtagactgctcttctca

SEQ ID NO: 856 - DNA, 357 bp, Homo sapiens
  Genbank Accession No. AA405310
tttaatttcagcagcatctttattgcaacaaagaacctgtaataaaatgcaacaaaactaatgtttcactttacatgattaaaagccatatacctaaaaatgagaaaacccataagcttactggagacatgcaattctttttatacaagtcaatgcttaaaacagcaggcacttcatgttctaaaattaaacacctgaattccaattttgctgaatacaatataaatttgttttggggttacttaaaaacaaacatacaaacactactttttctttatctgtaaaggacttatgaaatgatcacctagagcccaggaccttgcactaacatctctatatttgaggctggaagatggc

SEQ ID NO: 857 - DNA, 414 bp, Homo sapiens
  Genbank Accession No. AA405460
gcggccgccgggaccttcctgcacccgttcccgagcgaaacgtatacggcgtgcgtcgactccccccccgcggcggcgtcgggccggaggggcctggcgggcaggccccggcggcgggccggggggccagagcaagaccgtgaccgcggcgggccagtactcgccagggatgaccatgagcgtgtgatggggcggcaccgggcctctctgcgggcctaggcttctgcccagcgcccctgctcagggcgaggggctgaggtcacacctcggcacctggactcctggccaatcaaggcttgccagctgggaggccccacacgaaagactcttaccattttattaaaaacgcaaggacctcagagacgttcttttctgtatggacccttcctgccatttgtattttgtcccagagag

SEQ ID NO: 858 - DNA, 372 bp, Homo sapiens
  Genbank Accession No. AA405494
tttttttaacaaaatacttattttattgttgtaaaattaaaaatagtagacaagcatatatacagttcccaagcagagcaatacaaatatataaattattgcagttttcaaagaaaatgtaacagccaaataattgcctacttttttgaaacaaacttggtttttaccacagcagtttcattttctttttccaaaagtcttaacacaattttgtaaagtaaatttctaacgccagagagattaagttcaatgaccatagtatatgctactgttttaaagcaaggttaacacacacacacacacacacacacatacacacacacacacacacacacaaaatggaactgaacaaaagtcactacttaatacttt

SEQ ID NO: 859 - DNA, 377 bp, Homo sapiens
  Genbank Accession No. AA405495
tttttttttgctgcaccaaatttaagaacgccctttcaggcaagcagtggtctctagctgttaaaacatttcgttagtggatcacaatagcttctaaaactgcctttctagtaaaggccatcagagaggtaatactaaactgtgcatttgccaaataagaatatgaattgtataaaagctcatttccaatcctagatcaaatggcaaaagttctacaaagttggtttccatgtttgtataaaagctccgactgattttatgtattttgctatgaaattacctttgggtcttataatcagtatacctctactcaggaatgtgcaaatgattttatacagcacgacgctagtaccgctctgtatgacagtaaggttttt

SEQ ID NO: 860 - DNA, 346 bp, Homo sapiens
  Genbank Accession No. AA405505
tttttttttttttttttgaagtgccactctatattttatttcccagttaaccatgtctacattttctaagatcagtatattgttttctttgttatcatcattaggctccataatataattttacatcatatattattaaacatttatgactacaagaaattcttgaagctacttctacatgtgatcatatcaaagtataaattttgctaacaagacacgctgtgtaccaccttacagatttatagtttatgcggcagagttagaaatctgtgacaagtcctaacacttgtcacatctcaatgtggttttccttaaaaaaagcagccaatatccatgtaaacagtac

SEQ ID NO: 861 - DNA, 187 bp, Homo sapiens
  Genbank Accession No. AA405544
tttttatgtagaaaaaggctgacttttattttcctgcagagcatcttcctcgggagagcagggagccccaagtcatcgagttaagagcaggagaatccccttgactaggttggggtctgagcccagaggcagggcctaaaggaggtgcagagactagggccgggagtggtgaggcaaggttggggcc

SEQ ID NO: 862 - DNA, 340 bp, Homo sapiens
  Genbank Accession No. AA405715
tttgtttaaaatcaaatctttattcaaaagatagtcaaggctgacaacttatgcagtctgtgacaaagagcaagtcaagccaaggaaaaagctctcacaaagaacgtagctctgttctcttaaaatgtgtaactgttttcctggtagagcaaaatttcttgaaaggggcccagttgcgactttaagcagcgtttaaacagcctgcctccgtgtccagcatttaaatcagcacaagagaatcggctgcctgtgggcctgcctgagcctcagcctagcttggagtctgaggctccaaggaggcctgtgtgtataagccatcccatggtcaccctcctggaca

SEQ ID NO: 863 - DNA, 455 bp, Homo sapiens
  Genbank Accession No. AA405744
tttttactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctctgaaattatatgcaaagagttgtgggtcttcatcacacatttttctgtatacatcacagaggctcttaaagtgtgagatggagagctggcggggccgaagagtagggtctatgtctgccaactctaacagcctgcccgtgctttccaagcgctgcgcttcagggaataacattctgagccctcgatggcagtatttc

SEQ ID NO: 864 - DNA, 427 bp, Homo sapiens
  Genbank Accession No. AA405791
attagcaaaattactttattctaacaaatagtttaacacaaaaatacgaactagccctccagggatctttggggtctacgcttcccatcgcctcagtgtccggtgcatgaggaaggtgtcctctgaagggcggggccggagttgaagtcggagagggggcagaccgtccagggtcaggtgtggagattcataaaatagcgtttctgggtcacacaagatggtcatgtctggcccaggcccaggtggctcctgttgggaggttgggcccaaagcaaggttacactttgggaggaaggatccgggtaagggggtacatggaggaagccccacgcccagaccccatcacctttgggtgcggggctcgagcatgtgcggcaaggagagccaatttctccctgagcgcggcattcagaacctgttcctccgg

SEQ ID NO: 865 - DNA, 406 bp, Homo sapiens
  Genbank Accession No. AA405819
tttcttgggcgtcatttattttttgcataggcataaattaggatctggagataaaaaacttaagaaccaatagtgcagcatttgtgacaggagagcgcaaaacaaaccctggctgcctcgggatggagcggggcggcctcaccaccactgcatccagcctcatgctccagagcggatttgaggctcagtgctgcagtgaaggcctgcccgccttcttgccccttccccgcagccagaccaccagacacagccggaaccagtgccccaggcccctctccacggccaggaacaagaaactgagtatcacccagtgccccacagaacggggctaggaatcaagcccttagcttttcagttagaaaaacagaccttgaaaaatatatacataatacagtggggcctgctg

SEQ ID NO: 866 - DNA, 474 bp, Homo sapiens
  Genbank Accession No. AA405832
ctaatttaattctttatcattcaagtagagagacaggcattttccaaagcaaacccaaccctcgtgattatttctagccagggtgaagctaaggaaggtagcagtaggtggtaggatcagcaccttggttccaggcatcacgccagtcattttatttccatcatcatccttgtgaagaaatggaagtctggagaggtgaaatgatgaaggcaatctggccacaaatcttccttctggatcctgctcttcagggcatgcatctcccatgctgaaggttaaaatgggggtcatttgccaacaaatttgggagtccgcttctccctgaaggctgccatgccctctagccggtcccgggttcggaatattctgggcatagcacatcccttcaatggccatcccagatgcaatgtccacctccgttcctcggtcaatggctactttgcccagccgcacggcaatgggggcctggggaag

SEQ ID NO: 867 - DNA, 405 bp, Homo sapiens
  Genbank Accession No. AA405907
ttttgcagggaaagaagtcaggttttaatggtattgatatgtgagcaggacatcctgacattgaggtggccagaagaagccgctggaaggaaggaatgggaccacaccacccaacgctctgggcacatgatgctcaggttatgtggacttttcatttttttttttttttttgagacagggtctcactctgttgcccaggttgctggagtgcagtggcatgatcacggctcatagcagcctccaacttctgggctcaagcaatcctcccgccttagcctccagagtggctgggactacaggcgtgtgccatggtgcctagccaacattgatcttttatccagtgccaccacacacacattagcacctcaaaggtgggaagtcagtcatcagtcctcccctgttgtc

SEQ ID NO: 868 - DNA, 322 bp, Homo sapiens
  Genbank Accession No. AA406125
tttgccatttaacatatatttattgaaatctacttgatgcaaggcactgtgctagatttggtaggggatcagacatgaaaggccacccctgtcttctaagagctcacaatttaatgggtgggggagggctgaggaggagggggtgaagccaagtccacaaacagctctagtgcaaggctgattatagtgagtgccagaaaacagacaaggtaatgagatgggggaatgagaaaaaagtgccaacaaccaacggaaatacaaactggggtgggacatagctattgttctcagagatacgcaaatgacattgagggccaagttt

SEQ ID NO: 869 - DNA, 489 bp, Homo sapiens
  Genbank Accession No. AA406126
tttcattaaagaatttaatagggagttgattatgttgtagaatcatatcgtcctattctgtgacacattagaaacataaactttagggctttttcatctccacagcatagaggtctgatcgcttctgtctaaaaacggggatttgctggcgtatttcagccagcttcttcaggtctatgtctgaatacacgattgcttcttctgtgccagctttggctagaacctccccccaagggttcaccacggtgctgtgtccccaggcaacataggaggctttgtcatcccgggcaggagaggctgtggcacatacacctgattatcaacagcccggcttcgctgaagtaactcccaatgggctggtccagtggtcagattaaaagctcctggatataccaacagctggcagcctctctgtgcgtagatttgtgcaagctctgcaaaccgcatgtcgtagcagatgcccagacccactctgcagtaagctgtttc

SEQ ID NO: 870 - DNA, 340 bp, Homo sapiens
  Genbank Accession No. AA406145
tttttttttagggttcagttccagctgattttatttccttctcaaaaaaagttatttacagaaggtatatatcaacaatctgacaggcagtgaacttgacatgattagctggcatgattttttcttttttttcccccaaacattgtttttgtggccttgaattttaagacaaatattctacacggcatattgcacaggatggatggcaaaaaaaagtttaaaaacaaaaacccttaacggaactgccttaaaaaggcagacgtcctagtgcctgtcatgttatattaaacatacatacacacaatctttttgcttattataatacagacttaaatgtaca

SEQ ID NO: 871 - DNA, 447 bp, Homo sapiens
  Genbank Accession No. AA406216
tttgtaaacactttaaagacagacccacaatgcctttcaaagatgaaaaagaaaatgccctttccctcctgggctgaggggtgaggggaaggatagcagttgattcattcttctctcaaacttgctctcatccaatttggtgtcctcagggaggaagggagaaccatgatctggaagtcagtgcagaaggggtgccctgttcccgctggtgtcccaagctcagctctgccccagggtccggtgagcctcctccctggagcaggggcgctctgtccctttgagaggagtcagcaagcaagcccgcaggtcagtccgcagggtgttccggacaagatctgttcacttcaaaccacgagtctatgcagcttttgtgatagatgcacaggcagggcagcctggctatcgtgtccccctgcagcagctcctccaggcagatcacacactcac

SEQ ID NO: 872 - DNA, 419 bp, Homo sapiens
  Genbank Accession No. AA406218
tttaaaggtgaaacatttttatttagtttcattacagaggttaaatagacttttatgacatccatacaaaatatagcaatggttgtgggcataaataagaattgttctaactattctaactgattttataatgcacagctctttcagttgattacaaatatgaagtatatcacctcaggatgcagagatttttgaattctatttagcaatttccaaaagctgaagtctagaaccgaagacacatataaaaagatgatttttaaatggaaccagccaccttgaaaaatattttgaaaaacatgatttaaactttagaaaataaaacttttaatacttaagagataacatgatgcaaacgttgcttgttggcctgactttccaggactaagaccctctgggaatcaatggggctcggtgac

SEQ ID NO: 873 - DNA, 434 bp, Homo sapiens
  Genbank Accession No. AA406231
tttttgggtagggatggtatgaatttaatattttttagtattacaatatattcttataaaaaaggtgcaagtgaaaaaggacactgtagattatgtccattagcctcatttgtcatctgaggcagctggtgagaacagccttgggtcgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagacc

SEQ ID NO: 874 - DNA, 460 bp, Homo sapiens
  Genbank Accession No. AA406363
tttttgagataattgaaaagttttattataaacaacataagcaaaaaattcaatgcagtgggggcagaagtgtgtggatgacctgccaaacaataagtattcaaagtgttgagtgagggaggtgaggttgcaactatctttctctagaaaagaagagaactgggtattcatcaaattggttaaattgaggttcgtcaaagagtttctacagatacagctgaatatactaaacattgctctattatctgttgaattgctgtatttcactttttcagcatttggggatcattatttaattgaatttgtagagatcgattttccagacaggtctctgttcttcaatgaacaaatgataagaaacaatttgactccttatatgacaatggaattaaataaattgacactcatctaggaataattctacaatcatctccatctctaagattacctactgcaaaca

SEQ ID NO: 875 - DNA, 436 bp, Homo sapiens
  Genbank Accession No. AA406384
gctcctttcgccgcttctcccgctccttggcccgttcggccgctctgcctctttctgaacgatctggctgtcagtcagtgggagccaatagatgcagggagctgccttggtctttcggaaaaggtcatccagcagcttggcaggtggttcctcctgggctttctctttcttctcactcttcttttctttagacttcgcacgttccttgcggcggcggtcacgggaccttgatcgggaacggggcccttctcgaactttgtcccgatcccattcacgctctgatcgagtccgctcccgccgctccatttcccgttcccgttctgcccactgttcccgcactgcccgttcctgctcccgctgctctgcccgggggtgctgtggtggctggaccgggggtgggggtggggggtgcaggggccgtggtattccctgctcc

SEQ ID NO: 876 - DNA, 450 bp, Homo sapiens
  Genbank Accession No. AA406385
ttttttttttaacaaaaatgaactaaagagctttattgacatcacagtacattcaagaataattttaagaacattacagctgaaagagaatggcatgtttatagtcttattatgcactatattttttgaaaaaaacgtaatacaaagaaatcctattaagtaacttggagcagcattggaaaaagtacacctatttacagattaaaaaaaaaaaaagattctggtttcacctacacagccacaatgtgcctctataatgagacaagcccttaaaactcatggaatttttttaaagaacatcatggcattcttgccacatcattcctcagcgtttacgacggggaggggttgttgatctgaaaaaaaagggaaaagacaaaatttaaaaataaaaatgtattttaaattaaaaatctgcaattttaaataaataatattatataggatttc

SEQ ID NO: 877 - DNA, 468 bp, Homo sapiens
  Genbank Accession No. AA406435
gaatctttaatgaatatttaattaggaccttttcagacagtgtaatagtttggggaaaaaagatgcctttttccaacacaccactgagttgaagaggatggaaaaagtcaacagatgagtttcctgtctttcccgccagttcccttaaaccatttctgcttttcatttcttctccttttcttacatctctgcatctgtggactctcctatcgtctccaggagcaaggcagagacacattcttgtctgtgagcagatgacttgtctagaaatcatggacagcctgcaagtccttccagtcctcccaagaatctgacatggttttaggcagagaagaggctcagaggcctgctgactcaacatctcttacaagcgcctttgagtttctccaggaagcgctgaggttttctcagaagtcaaaaaactttttctgtattgtttgaaagctggtccgactccctgaagccgtg

SEQ ID NO: 878 - DNA, 477 bp, Homo sapiens
  Genbank Accession No. AA406542
ccaggctggtctctgtggtttttattagtgtttcctgggacccatcaaacaaataaacatattttgaaaaatataattctttgacaaaacaggaatagcaggaatagtttgaatttaacatagcttagagggaaagatttctgattttttttaaatagtagcaatagagttgtttccacaaattgtcaacccaggagccagatggaaagaaaaacaagaattatgcagataactacagaaagattaatcccaatttagttaaacttgtgaaggcttgtacgtttcagaggttcataagacacagtctcaacaggagttttttttaataaatgctctatctctagttccagaaactgaattccaagaagctacactgaggataattcagctctgatattgtgattactgtgatgttctttcattcatacagtaagtatctgcccaatacgtaactaccgagatctattgcttcctaca

SEQ ID NO: 879 - DNA, 497 bp, Homo sapiens
  Genbank Accession No. AA406546
actactacttcctgttttcccctttactactacaatttaagcctttaaaaatggcaattttttagatgcttgagatagtttgggggatccctagctcttatcatggcactctgttgagtttgtgaaatgcatcttcaaagaggttgtcaataatatgcaaatttttgaaaactagtgagattactaattattgatgaataaaaaatgagtacttttaatctgccaagttaaagctctagaattccttttctccagtaataactcgcagcatcactaccaatggaagggacctaaggaataccgtgtacactgatatacacgaagctgctcctcatttttttgtcagattacaaaagctgggctcatgtagttatggcctatggacctctttttaagttattttagcagaagtagatgatggtctacaccttgctcctcttttatattaactgtccctaagccactctgatgactattctaatcaaaatcagtatagc

SEQ ID NO: 880 - DNA, 484 bp, Homo sapiens
  Genbank Accession No. AA406610
tttttttttttttaaagacaggttctcactctgttgtcctggctgcagtgcactggctattcataggcaagatcccattactgatcagcctgggagttttggcctgctccatttccaacctgggctgggttcacccgtcctgatgcaagtttgtggtttcctgcttcagggacatcaccatattgatgccaaacttacacccaactggcatagtgtaccacagcccagaactcctgggctctagggatcctcctgcttcagcctcctaagtagctggggctgtacgcatgtgccaccaaacctagcaattattatttttaatcttagaaaataaattgtgtatagaaaggaatagttagcacatttatgtctaaagaggaataaaaaaggacaactgggtttacacaaaatgcattgaagtgactgatttgaagcagcctatcaagtacattcaaaccaaatggcacaggagattgtcatctca

SEQ ID NO: 881 - DNA, 398 bp, Homo sapiens
  Genbank Accession No. AA410181
gattttttttcctttgcagatttttttttaagtagacatagtcttttttttttttttttagtagacatagtctttttttctttctcattttacagcaaacattgcaaatatagaaatatttttttctgtacaatagaacgactacagtgtacatgggggctgggctgggggacgtgcctcccagcccttggccgtcctggcaccccggccgtccacaggcacagcctccacccaccctgagtccagcagggctccaggacctgtcccggatgccacttggcgccgcagttcactctgcccctctgcagtggactccggaggcggcaatgaagagacggactggacagagaatccacagaaaaccacggaccgaggagatcacgtgaggggccccgagg

SEQ ID NO: 882 - DNA, 417 bp, Homo sapiens
  Genbank Accession No. AA410255
tatgtagtaagatgctgcagaattttattttttaaatatgccgtttagagcagacacagtcacaataaaagttaaaaagttacaatgtgtccagtgtatatacccaggaaatccattcttggtacttttcaagagctgctgttatactgagtctctgagaagtccccttagataatagctgccacttttcagtatggttcagaatgagtatcttagtattctttctattttgctatggttctagtttatcaacctactttattagctgaactgttggccattgcttgctgaccagtagaaactcattgtgctttagttattggaaagtcaccaacttcacgtccatttcattctctggtacagggaagagccatccttgggattatgttggcgatcacagttctgggacagttcttc

SEQ ID NO: 883 - DNA, 199 bp, Homo sapiens
  Genbank Accession No. AA410469
ctgtggagcatttatttcaaccaggaggtaaccaaatctacatacagtctaaaaacggtagaaaaggtgagtaaaaaggccctcgctccatctagggtggggatggagggtggggatggagggtgggccggggcaagcgtcgtacctggcacccagagaggggctgggcagcaaggacagtgccgagtagagggaggct

SEQ ID NO: 884 - DNA, 467 bp, Homo sapiens
  Genbank Accession No. AA410507
aatgttgagcagccaaaaagtcatggtttattatatctgaagaaatttcataattcaaacacaaccaaactgtacattttacaatcacattctatttgtaaacagttaaaagccactgacttcttttgcatcttaggacacaaacagttagaatcaaggcaatgatatgatggcaaattctgtactgttaaaatttttacccttgtttagtctctcttctttgactaagcaagcattataataccatttgtgggcaaaatttggggggaggaaagaaagtttaacatggtgtaactcgttagtttgcaacaacatttaaaattttctttatacaacaaacaactctgtaagcccaataccttggttacagtatgcatagttactgatttcggctttaaggtacaacagttaaacattaacacagtcacgagagagcagaaacatatggagccacttgatgggattac

SEQ ID NO: 885 - DNA, 438 bp, Homo sapiens
  Genbank Accession No. AA410508
tttttttcaggcatattagctttaatgtaggtggcgatgagtttttaggccaaggaaggaataatgttttatgtaccaaagccttttgtccccattttccatcatacgaatagtattccctgttgctaagccgatgatacattacccttttcccataggtgtgagtggcggtctgaatggagaagttcaatagttctgattgcagatcctatgcagaagagataataaggaaaataatctttgtctcctggattaagctgaggctggcaaagagtgaaatgtcccaagccctctaacaacaaacaacatactttgtgttgtcctggatgctggtctggttgccaaatatgtggaactggccccatatgcgtgtactgttgtccatttcatgagagtaggcttgaggacaccatgggcaaggatctgatggttgccagc

SEQ ID NO: 886 - DNA, 301 bp, Homo sapiens
  Genbank Accession No. AA410523
gttttgtttttcgtggatgaggcttttaatccggggtcagccaggtacagcattggggacatccccaggcccagggctggcgatgtgctgggaaggaacttaggtagagaggtgggaagtgaaagcatagggaggcatagccctccagaggggaattctaagacagacagttgaaggtgaggcctttgaaaaacaatgggaacatcacctcccaaagagggactgaggtggctggaggaaccagagccgcctctgcactctgcaccgagggtcgcgtgtggctgtcaggagagcagcgtaa

SEQ ID NO: 887 - DNA, 329 bp, Homo sapiens
  Genbank Accession No. AA410962
aaatatttaattcccatttatttaaagtttcgtcagtctgtgtacactatttatattaaaaacacaggaagctggggctcctagcaaaaatatacatttcaattttggagattgttcagacactgagaagagctgtatcctcagcaccagacccgggtgggggcagggacgcggcatgtggcgcgggagggggaggtgggtcccagcagctgtcccttcatagccttggcctgaaaggaagcaccccaacccccatcagctgggtaggtggggagcgggaagaatcctgccagcagagagtgatcctggggcatggaagggaggctgca

SEQ ID NO: 888 - DNA, 425 bp, Homo sapiens
  Genbank Accession No. AA410972
taccaatgccagaaaacctttatttccaccgagacctctcatccaattctcttctttccgggaactttttcccttccctactccaggtcgtaccctggccactcctttccttttggctggccaatgtctcctctgtaggctccagaaggctctcagggatgcaggcggcctcctgcagggttgagttgcaatgggaacaaagacagctgtggtcccatagcaccctcatctggtgacatcctgctactgacagtcaaaagaagccttcccagatgaaattttagtcctctgcgcagcatgctcttcttccagcaaaagagccatgtgcagtcgggtctgctccccatgggggctttgatgtgggcccagcagtggatcagccttccagacacgctcaactctgcacactcttcctgccgcctcag

SEQ ID NO: 889 - DNA, 267 bp, Homo sapiens
  Genbank Accession No. AA411502
ttttttttttttttttgttacacagctctttaataatagtggccatagctgtaataacaatgacaacagtaggtaacggtagtcataccaacagtagggcagtgcattttatattacaactggtttcttgctctagtaggcttggggatgggtgaagacggacagggctggcgcagaccctttccttctcctctccagcccacagtgatctgggcttttacaagacagcctgcttccattcagtagtgtgggaaagttccttcttgg

SEQ ID NO: 890 - DNA, 391 bp, Homo sapiens
  Genbank Accession No. AA411685
atttttgtaggcctttattaactcatgaaaagttcacttgctataaatagagccttaacataaagtgattttcggttctttagcacaatttttaaaacaatttctccaacagaattaagtgaaatctcatttatcttaaagcaaattagaggacttataaaaaatctttccatttctatagagatgaaggaaattttaatacagtggttctcaaactggggtccctggaccagaaacatctgcatcacctgggaagtgattagaaatgcaagtgatcaggccagaccctctgaatgagaaattctggtggtcgagcccagcagtctgtttcaccaagcccccgccagatcgttttgctgctgctgaagttgaagaaccactgccgtaatga

SEQ ID NO: 891 - DNA, 379 bp, Homo sapiens
  Genbank Accession No. AA411764
tttttgcagagatggggctttgtcatgtgacccagcctggtctggaactcctgggctcacgcaattctcccacctttgcctcccaaattgctgggggattacaggcgtgagtcaccatgcccagcctaggatgagtttagtaagatttggttatgctggggagatgggaaaagccaggttaggggcacgcaggctggaggaacggggtctgtgggggtggatggatagccatggaggcagaaaggagcctctgcaggaagagtctggaagagcgaggaggaagcggtgaggcaggggagcactgtggaatggccctgaggccaggaggggctcaggatgaccaggcagaaacagagcgggtccagggtggaggggaggc

SEQ ID NO: 892 - DNA, 425 bp, Homo sapiens
  Genbank Accession No. AA411795
tttcaatccatgaaataaatatttatttatgtaatacaatttgctaaacaccaccattattaaggagagcactaggaaaaactaccaaacacagcatgtgaaacagttgggcacggtggtaaagggcacagactctggagccacagctggctaatacactgcaatattttatgtttagcaaattatagctggtctgtgtataaccagaagagcggtatctgggggatcaggatatctaaattctagacttacagcctggccctgaatctaactatcaatgttgccttggaaaaactgctcaaacttttgatgtctaaagtttcagacttgtaaacttgagagggttgaggtccaaggtcccttaaatgtaaactttaaaatgcttttttgggaatctttcaaatcttcaagctcttcaaagtgca

SEQ ID NO: 893 - DNA, 330 bp, Homo sapiens
  Genbank Accession No. AA411813
tttttttttttttttttttttggctatagagcatttattgcaaacaaaattgaggtaaaagaagctgacccagaacccacgcccgtccaggctggggaagtctctactcgccccacaccaggccccgagcaccgcgtgcccgaagcagcccccagaggacagacgggccctgcgcactgaggtagctgcatcttaagcccccatgagtacaactgcccagggctgcccaattcccagaggtgaggaggagagagaggcaggcagggggagccccggcttcaggtggggcacaccccacaccctcaacaaacctcccagcctctcgggctg

SEQ ID NO: 894 - DNA, 426 bp, Homo sapiens
  Genbank Accession No. AA412034
tttggaaataaaaattttattacttacaagtcctaggggtacacagcatacctgaacaccacacagggaggtcaggaagagagagaaagggacccatgggccaacgcctttattgggtccagggcattatccaaacagagttttagttggtgggtttaaagcaagcaggcatgcattgaggaggtcacacagtgactgagagatagtcactgtggcatgtctgtgtagtccatgtgcggtatgagggttgggggggtcagtcaggtaggccatatgtagatggcccatagggaggtggttaccaggaggaatttatataaggcagatatctggatcaaccacattgaggtatagaactggaaactgtgtcgggtgaatgagccctgctttttgtatgagaaagtccagcttgtatgcagaattata

SEQ ID NO: 895 - DNA, 521 bp, Homo sapiens
  Genbank Accession No. AA412063
ttttgcaaagttaacatttttattgaactgaaattggtgtagaacaggggcaaccacagctgctgagctctgtaacaactgaaaagcccctgtgacattttacctttgagagtcctaacacggtttgagtggaacagctgagaaacagcatatatatattttaacacctcaaaatagtttgaaatgagcctcacagccttgttcaatcttcagattacaaataacattgatagcatctcctgtggccttcagttagtagtgccagttaatattgtttctgaaaactttcctctcaaagtgctggctataattttttttccatccagtacacataagaaaaggatttagtaacacttgggcaagtaataaactgtagaactttaaaagtagtaaaggcatataccaagcatacgtgactccacacattgtcagaaaggcagtggactggctaacgagtttctgccaagtttcagaagcaaagaatgcactaatgaaaagggtaaggcatccaagcagagtgt

SEQ ID NO: 896 - DNA, 522 bp, Homo sapiens
  Genbank Accession No. AA412068
ttttaaggaaattagcctccctgggtacttacagtagattgagtattgagagatttacaaagatataattctttggaagattacagaagatggaaacaaaatcaaatctttcactttcaggtactggagttcattaattctttcaccaaaagcacatcactgaaggaaaatcagaagtggttttttagttattattaaagtagttcaagacccagggaaccccttgagatgaaaacaaaacagtattcaacttttcttcacaagactaccttgtactggcaagacttagaggacttctggcttgaaaaatattgcttagaaaacttaaaaaaaaatcaacaacaactatattttggacaaaacaatttttttttaatctgtcttgtaaaatccttacttccttttgagtctctgatggccacaacatttcatttgagatgtttggcagtcacagcttcaggggttatggttactgattatctaaaccccttaggtcagaatgaacaaacacagttcatgtaa

SEQ ID NO: 897 - DNA, 329 bp, Homo sapiens
  Genbank Accession No. AA412149
tttctggagtcataatttcagaaagagtaaagataaactttcttattaaaaactggttttaggtccaaataatgaagatgtagaaaaacaacctacagtcccattataacattttgaaattcatttataaaaaaatttacagcagctgtaaagtttcagtatcgtaaggacaacgtgatcctacaaacagccaaaggatgtagacaagatgtttttctgtcttccaaataacacaaactgaaaagaaaagcctttgcttttccttggccacataaaactagtatttccacactactggttaataaccccaagaaacctttgcttctctt

SEQ ID NO: 898 - DNA, 416 bp, Homo sapiens
  Genbank Accession No. AA412184
tttgaggatgccatgttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctcttgctggcctctcgctggagcagtgccctcaccaactgtctcacgtctggaggcactgactcgggcagtgcaggtagctgagcctcttggtagctgcggctttcaag

SEQ ID NO: 899 - DNA, 305 bp, Homo sapiens
  Genbank Accession No. AA412301
tttatagtgggtccattttccaataattctcaaaggagtctgagattccccaagctttcagaaccgctgatttgttctgtgtcagaccttcccattcattgtcttgtcatctcccacagcctccagaatgggaaaatacacatcattgcatgaaagaatcagtattaacaaaacattaatgacattcccttccccatccctgtggatcaaggcaagaagggccattcgccgatgcagataccaggagttggaaggccgcagcagttttgaggcctgcgttcagtgtctggacttccaggtcaagt

SEQ ID NO: 900 - DNA, 363 bp, Homo sapiens
  Genbank Accession No. AA412403
agtaaacaaacaaaactatttaatgagggtgtttagctcttcacacactttaattaatggaaaacaaaatggaagtgtgtgaggctcacggcacggatgaaactggaaaaaggaagcttggaatcttaggctccagctctgggcctcgtcctaggaaacagcccaggagctctctagccaccctcgtatgctaaacacctgaggacgaagctcgaattcttctttacagatggggcatggttgcacggagtccccttgcaggagagagcgctgtttcaccttctcccattcatctgatgacagtggaggtggtggaggcccaatgaggcccaacttctgtgccaaagtcaacggcggcggttt

SEQ ID NO: 901 - DNA, 279 bp, Homo sapiens
  Genbank Accession No. AA412405
  unsure (1)..(279): n = a or c or g or t
gtgattcaaggttatagctttactgcaactcaggacagtgagcccaagccaggtgttggctggcgccagaacaaggctcaaatgcggacttggacacacttcgaaggagggctgctctgccctgctgttcgggcgtggggggtggggggcgggggcactgagctgggcattctgtcctcctccctggatgtgcagacatgggccatggttnctgacgnacttcacatgtgaacctgggccttctgtcctcctccctggatgtgcagacatgggaccatg

SEQ ID NO: 902 - DNA, 380 bp, Homo sapiens
  Genbank Accession No. AA412481
tttcaattcagtaaatctttattgagctcccacggggtgcgtgaatttaggatctataatttacataagtaggaaagtgttactttagcccccttttttaaaaaaaagcaaattacaatttctgtatatatttcaagtgaatcatttaatgtgagtgaggctcagttaggtgttaccataagtattaacagaagaaaaagggaaagcacaaacattttccctctaccagaaaagggtctgatgtaagataaactagcctgttggtttaacaatagctcattaaaaaggccagagaatctgggagaagatgtacttggaagcactgtcctctgagggcccattcccaagggacagcaaaatactgaaaaaaattaactggc

SEQ ID NO: 903 - DNA, 428 bp, Homo sapiens
  Genbank Accession No. AA412520
ttttaggaagaggctgaatttaagacaaagaaaacttgaatgttaaatatttaaaggattataaaagagcagcaacattcttggtctatttttgtaggcaatagatatgaggattaggttctgactggaatcctgagtgtcacggagacagcccccacatgtgacccacctgtagttttccaacaggcatttttccaagagtgagttttggaacattaaattaagagcaaattaaattttctcaggctttgaggggcctgggctgaatttttttaatgtatagagtttagaatcaacgatttaaagctcagtgtcccctatatgggtctaattatgaacatgccactatgtccacattagaattgaactgattttgtaacaagttattttctatgaaaccctggaaggtggtgaatgagggaaagtgc

SEQ ID NO: 904 - DNA, 547 bp, Homo sapiens
  Genbank Accession No. AA412700
ttttttttttttttttttttcatctctgactttaatggcttaagcaagaacatggtttccgtggctccccctggactgaatgctggaggatatatacttcacagtctgaggcctggtcccaggaactggcaatctaacaggatggcaagtggttttgaaacatatagattttcaggatggaagtttgattcttcagattgtgactcatccgtggaaaataaacggtttagcacctaaatctgtatattcccatcagtggcttggctgactcagttgtaaatagggtaccctccatctgtctcccacccatatgctccactgtccccaggccctcagtgcctgagccctagggggattcgagttggctgctggattcatttcctgcaagcaggcctgcaaggtgacctgtctctctaagatggagagctggagaactggcctgtaactgcaaacttaaactcccttggctctggggaatgtaaagggtgtgggaagggtgcacctgtggccaggtgaacctgggagtgagtccatacacaacacacac

SEQ ID NO: 905 - DNA, 365 bp, Homo sapiens
  Genbank Accession No. AA412720
tttttttttttttttttttctgcagcagatttttattagatggaagataacaagcattacctcataggtaagtggtaagaaatggcaagtacagccaagccacagaggagtgaggacattactggctatgggaatgggtacttatgaaatctaagggttgggtctcctgatgaactataactacccagtaagctcttctctttggcactcaatatgaccactgctggcatgaaagggtctacagtagctacttcaacttggccaacagttcttccagttctggtcgagctttgaatcgtcccttgaagtcttcttcagtgtgctccttcactgacagtctgactccttcaggaagactgctttgg

SEQ ID NO: 906 - DNA, 369 bp, Homo sapiens
  Genbank Accession No. AA416723
tttttttttttcgggggctcaataaaaacttttaattacatttcagagacttcgtacagtgcaacagtgaatattcactgttaattttcacaagagtccatttcatcaaacgttcagagagtctgccttttcattcccttgttcctcagtgctccaatcaggtttccagtctcccagaggtttcttttagttttgattaccgaccaaaactccagtttagggagaatggaagtccaccgtcccatccccaccaaaacatatttcagtcaaacccaatcccagtccctaaagaattaggaaagtatgggccaagggtccttttaattatacacacatcacccttaaaactgcgtgtgtgtacgagaaata

SEQ ID NO: 907 - DNA, 372 bp, Homo sapiens
  Genbank Accession No. AA416740
tttggctgtaaaatcatatatttactatgtttgaaagaaataatacaaaaaagagaggaaaataaaagcaaaccctaaaaggtcactaaagaagtcataccaacctcatcacttgctttgtatcatctattcatgcaacagcagtactattactccacctggacacagttaaactcatcttccttttcaaaaagggatccaattatttcaaaaacctttgaagcagaggatttgctttattaaagattatcttctgttaggcaacactggcaccccttgtttgcagaagatgattacgtggtggtttaaacactggttgtaaaggaatgtgcctcataaaaacaggaaggaaatcaataccagatctattca

SEQ ID NO: 908 - DNA, 493 bp, Homo sapiens
  Genbank Accession No. AA416873
tttttttttttttttcccgtggcactcaatcttttattttcttaaactgtacacaaacgtacaatactttaacagcaagtctatgggaaaattgtttggttttaaattattatgaaacagaatctatggggagctttattaaataaacataaagatgaggatttaaggatacacacctgcattctatcatagtcatttttactctaccttctgggtgtgtaaggatggaaaagacacatcaaaccgaataaacaaaatccattcataccctgaaacgttggcaggccactcaagggactgctcagaacgtccacctcatctcagatggcctcaccgtctaataaaattaaaactgatctgttggcctctttggttccaaaattatgtataatacatttaactgtattctcttttttttttttttgctgctataaaataactttttttcaatggcagttctgactaatctgcacttaatcagtgcaacataaaa

SEQ ID NO: 909 - DNA, 491 bp, Homo sapiens
  Genbank Accession No. AA416890
  unsure (1)..(491): n = a or c or g or t
tttggagtccaagtctcttatctttattttaacagactggcagcatcaggtcgcagcagcagtacagggttcctggctgggcagcacaggcctggggcgacagtccatgtcttgtctgcccagggcagtgtcaacttaggcctctactccatggctgtgaaaggacagcagcctcaaggcagtctagctcctgggcacaggcagccaaaccccctcccatatccagctaaaccagctccaggaaaggagaaggtcctgtttccccggcatccttggggcccagggactggttctttcaccggatgatcttgcctggttgaaccacagcagcatttgggctttttcatcctttcctacatcaagaactttcccaaatgtgggccctgggcgtaaggcaaaacagtggccttggccaaggctctgggcctctgggagggtcccatctggcatcaggtggcgnacaaacagggtgtcagcacggagagagctgg

SEQ ID NO: 910 - DNA, 418 bp, Homo sapiens
  Genbank Accession No. AA416936
ttttcctaaaatattttttattagaaatatagctttagtaacaaataaccatttgatagttacataaacatataacagatatgctctacatgtgtaatttaagtacattaatatgagcattctttatgggtatacatcatataaaaataaatcattttcatacttttttaaatgttggcactgtaagtcacaagaatgagctactcagtcagtctccctatttcaggaagcctttgcatggaaggacagagtctctgtgaagttctctgggaagtaaaggaggcgctgatagggactgaaggctgccttagctcagaagagctcaaggcaacagggcaatttggggagagtcacaggcacaggaagggcgtagatagaagatacgtaaaatcaaatcaggaagttttgttatattgtt

SEQ ID NO: 911 - DNA, 382 bp, Homo sapiens
  Genbank Accession No. AA416963
aacgattttcaccaactttattggctcccgccgggaccctcgccgcccacctccccgctagatgtcaccggccctccatgacatccagcacattcaaaagcattgcgggacgaccatgaaaagggcctttgctggcggacttcccttgagggcggcgtcagggtcatttgctcttcgtcttctgactctccgtcttcttgggcagcagcacggcctggatgttgggcaggacgccgccctgagcgatggtcactttgcccagcagcttgtttaactcctcgtcgttgcggatggcgagctgcaggtggcggggaattatcctggtcttcttgttgtcacgcgcgggttgccagccagctccaggatctccgccgtaaggtac

SEQ ID NO: 912 - DNA, 379 bp, Homo sapiens
  Genbank Accession No. AA416970
gagatataaaaatctgtatttatattacaatgacataaggacacagcacggcccacacggtggacaggtggccggggccactttccccctctagcgcaccccccctcaccggcaccaggccctcgtgtggcccccgactctggcacggaacctgccctagtgcccaacatggacctggggccaccctgctggccgagggtcagggtcctctgtgcaggcagtggggagggggtcccaggttccctgacagagggaggcagggcacgggggagcctgcctcacccagcggacagcacgggccggggcagacagagcagggaccctagggccacagaccggtacagggttccaccacccggggacacaggcccaagcaccg

SEQ ID NO: 913 - DNA, 354 bp, Homo sapiens
  Genbank Accession No. AA416973
gccaagaaaagtttttattgcaagcacagtgagcagaaagagatgtcttctcacacaaagtggccacaaggtctgccattaactaaatctctttgacaagccttcattggtttaaagcatatgaattagcttcttgctatcaggtgtacatcatttctgccatgtgggacattttcttgggaatatacaagtaatactccatgtagcctgacaggtcctcaatggtcacatcatccacgaagactcgagcttgctcagaacaggatcggggagagccagacagagttctggcgtgcagcgactcgagagtagtcctcaagtgtggatcttcgttctggagccaagggagggaca

SEQ ID NO: 914 - DNA, 418 bp, Homo sapiens
  Genbank Accession No. AA417030
gaaatgtaagtatacagattttaatttatttttaagaataattgtatattttaaaaacaggacacgtactgtatgagtaaacagcgtggctaacaccaagtccacactggtaagcttttgagaaccatttacactatgttgacagtagtactgctgcaggcagacagcggaagaataaataatagtgcttcaagaagagtagtgattgagaggataggtaaagagggcgcctcatcgtggaagctagagcaggaacacctccccagtagtgacatgtgcaaagttccagatctccacgacaaagacagctcaacccactggaacaaacagactcccaatgtggctggcaactgcgggggtagaagaactcaggcaaagtaggcacaggaatgggggagatgagagccaagggacaaac

SEQ ID NO: 915 - DNA, 533 bp, Homo sapiens
  Genbank Accession No. AA417046
tttttcacatgttggtgttcatttaatttactaagtattttaaaaaataatgccttccctccaacaagctcagtttgcaaatacaaacagtaggtgcacactgaaaaataataatctctaaatctttttacttgcaaagactcaactgttatttaaaaaagtctccctttacgggtatgcaaatttcctacaaaatttcctcacaatcttcaatcaaattaaagttggattatatcaagtggctgtccattcagtttctttctggaaatgttgagttatcctcctgggaatattcagagtttcagggttttagcacttatggcattatagatgtcctcagtcataggcacatacatttttgctgtgtcatccaagaaatacaaggcatctttgatgacagcagggttaaagccctcctccaccagggtcattttgcggtgtttaaaagttccagtgatctcaatggtgtcctgtattcttagaaaccggggccttgcataactaggtaggtaatcagcaatgtgctgaaagag

SEQ ID NO: 916 - DNA, 437 bp, Homo sapiens
  Genbank Accession No. AA417078
ttctattttgcagactttcttttttaaaagcaaaataaattgacatgacttgttcagggttaactgtttggcaggtggatgatctgtggccatccatgatgagatcacctccctgccccgctggcccccagcctctagaagtcagggcttctgaggcccagaagctcagcgccacacctgttgaaggccagtgatgtcagagttactcttccttcctccagcagcactgacagcagtttattgtacgcaatttctagaactcagatgttctagaaggaagcaaacatattctgagatcacagactatgactatgctctcagaatatgttctagaacacctaagttgcaattcttaaaatcaacacagcgtaagactgctttaggaggaagtgatcaagctcaaagcaacctaggcatgatgtgccttgtttgtttat

SEQ ID NO: 917 - DNA, 396 bp, Homo sapiens
  Genbank Accession No. AA417373
ttttttttttttttttttggatcaccagcaattctctttaatcctctttcttttccttctaaaagcttttgcaaagtccaatttatttttacagtaaatagattatcttttaagaaaacgcactagcaagattgtagcaaagtgtgtttatgcaaacaggtggtgcagagacagaggggcggaccttgtgggcagctggaggaccatcccagctcatgggccacgcacagatgggagcacctcagtgttttcagccaagagaacacaagtctcgggatccatgtggctccctcaggccctggacccaggcaggcaggacacccttgaccatggggcaggggacatcccagcatcttgtctgtacccccaccacctgcgtggcacctggtcctcaga

SEQ ID NO: 918 - DNA, 365 bp, Homo sapiens
  Genbank Accession No. AA417375
ttttgagagaaaaggaaaaactttagttaaaatctttacaataaaataattatgactataaatctctttagttaaatatgtacacattacatggtatttgtataaagaatggaaatggataaagtttttcaggcaaatctaatgcacaaatacaccatcttttagagtataatgtcagtttatcattcgttaacagctgtgttagacagtggctctgctttgtgcaaaacgtgataaacaaaattaggaaaaattctgcaaaattatttagttccccaaggaaattactaaaatagaaaatggcaaaagaaaaaaaggttgcacactgaagcttgattgtatactcaggctacaatgaccagcac

SEQ ID NO: 919 - DNA, 586 bp, Homo sapiens
  Genbank Accession No. AA417884
tttttcctgttttgaaagtgttttaattagacaaaagcatcaggacaaaccattttaaaaacaaagtcttcaacttgggtgttgagattggcaaaaggggaagcaagggaaaagccaaggaaagataaaatattcagaagaaagtcaaagttatctgcaattacatgttagaacagattttgcaggttaaaaagatgttgcttaaatatattcataagcctgttgtaagattttcacttatgcagtttcagaaaatttagctgcttaacatatgacagaactgtattttaacaaatgacattaaaagtcaggagagctactcagttaattgataaagtagaggcaacgtgggggagccctccccacgtttattgaagatttgtggctcccccagccccgtttgcctgcatcaggctaacaacctcattcctcccatagagcctggccaaatcacaggcggtggtccccttatggttccgatgccccacattgctggccgtgtgcttcaccagggactccaccaccgggaggtgggccttctttgggcagccaagtgcaagggcaggttcccttcattatcctcgat

SEQ ID NO: 920 - DNA, 427 bp, Homo sapiens
  Genbank Accession No. AA418098
cacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaat

SEQ ID NO: 921 - DNA, 435 bp, Homo sapiens
  Genbank Accession No. AA418398
tttttttctctggtataatgtttatttaaatagtaatcttaaaaaggctttatacaaatcatataaacacagtttgacattgttgtttattttttacattgaagaatcacagtaaaagctctcaagttcccgtgatctggctcagcagtgaatggtcgaatacctctaactgcaaaccctgaaaaagttaacctgctatgtgacaggttaactctttcccttgttttcttgtcattcatgcttattccttggaccctcatccctgtcaactcccctgccccaccaaagacagaaagcaaccctgtggccctgttgaccacctagtccgggagagtgtggaggtaatgtgtcattcagtacaaggcaaaaaggagatcaatactggcagtggggtttcccaaagggaatgactcaaggagatgggtcagctagcct

SEQ ID NO: 922 - DNA, 551 bp, Homo sapiens
  Genbank Accession No. AA418907
tttttctgaacaatatctttatttagctcaggtagttgttcttacacatttttggatacctgggttagaattttccctattacattaaatcaatggttcttaagctcttatgcaagcatgcaagctcaatgcaggctagaatagaaggattgttgtgtacaaacattaaaaatagacattttattacaagagtgtagagaagggagaccaatagaaggtaattgaaatacccccccctcactccagccctagtcctggtgcctggatatgtgcactccctgtgcgctctgatccccgcagacacaagtccccagcccctccaggacagcaataagggtcttacaaggccagaaggcagccctgtttgttcctgcctgcaggaagaggcagaggaatgtgatgttcccaggaactgtgtcctagacccatagggtcagattgctcagcatagttcaagcagtgagactacctcatgtgcagtatcatgggctgtctcttccattactcttggcaggtccaattttcaagattggacaggtcctggttggcta

SEQ ID NO: 923 - DNA, 274 bp, Homo sapiens
  Genbank Accession No. AA419217
gagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcactccagaggtgcagtcttgggcaggatgtagcatgttcagagtctggtga

SEQ ID NO: 924 - DNA, 513 bp, Homo sapiens
  Genbank Accession No. AA419507
tgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgacataatggctcag

SEQ ID NO: 925 - DNA, 468 bp, Homo sapiens
  Genbank Accession No. AA419608
tagagacagggtcttgctatgctactcaggccggtcttaaactcctgggctcaagcgatcacttgcctcgacctcccaagatcctaggattataggtgtgagcgagccaccatgcctggccttaaaatttttttaacaactacctgtaagcactcaggacttagaaagtattttgactaatatttaaaattttaaagtttttaaaaatttcttttattcatagaaattaaaagaaaacaaatagcctcttattttttaaaggagggtaattctgaaactaatattttctatcaactacggctggtgatggtaaagttctatatattaatgttactttttcatatatatctctcttaaatgacactttggctttcgttctctcaatgtttatctctggggaaaatgtgattaagataatcagtattttagtatatatcaaaagttctaatataagttttcctcatagtt

SEQ ID NO: 926 - DNA, 484 bp, Homo sapiens
  Genbank Accession No. AA419622
tttttttttctgcaccaaaatacatacattcatttatttctcattgcagcaacaagataaacaagtataattccatggtcaaggagttacaaatagtagcaagcccagtaaccttgagcatatctataaggcaaataaaacaaatatttctttcatagtgtgggcatccaactttagataatctggaaaaaaatcactctagcccctgaataccatgatgtgcatgatgtgcaaaatgaaagtatcacccaaaatattttcaaagctaaaaagaaaatatttaaattcaaatactttaaccaaattggaaatgcaaacagtacacttagagtcatccttagccagctgttctccaaacaaaagatcgagaaacaaaaccaagaacaatgtaaaaaagaaaaggtttatctagaaaaactggaagctcatcaaagtcacatttcttcttctgattcttgttctcgttcagcatttttcagaagtc

SEQ ID NO: 927 - DNA, 450 bp, Homo sapiens
  Genbank Accession No. AA421049
ttttttttttccagaggaaatgtttcgttttatttttgctcataacctcccaaaaaaatcagtaccccgccatccctcacccagacacagcccctctccaacaccttcacgaaacactgattttttttcttagagctaaaatgaacacccagtcaccaactacagccctgccctgcccctcctcccactggcctgctcatcttcccgcactgcaaacctggccgcctttagcctccctcccttagcgtagtgtcccaaggtcacctagcctgctttttgcctgtaggatatgggtccccttctcaaagcccgccctgacttacttcctcatttgcatagtccttcagctctatcctgtcgccactccacccaccccagacaaccacctgtaagaaaccaggtttgaaattcaagagaccaggtttccaagctcccagctgcttccctgtg

SEQ ID NO: 928 - DNA, 404 bp, Homo sapiens
  Genbank Accession No. AA421051
tttctgcgttttcatactctttattgccaacggtttaaaatggtcaacataaaaaaaaagacattttgataataaatactgctctttgggctgtaataaataaaaagtttattaacaaggaatgcacttttccagccacaagtatcttcaaaaattaatgaaaaaaaattatatatggccatagttcacagttacgcagccaaaagctgctccaattacagcctttaaacaacatgggagcttcctcccttctccctccccttcaggaagtatattcacagttccaaagtcctctggctgaaatgctctcaacagagagaatttaagaatcaatgcacctttctgcaaaattgtctgaaaaaccttttaaaacaggtatctcaaggaaaactgcattctggttc

SEQ ID NO: 929 - DNA, 428 bp, Homo sapiens
  Genbank Accession No. AA421052
tttggcattcaaaatgtgaactttaataacaggtcagagtgggggttccccaggaacgagaatgacggaactggtgctggaggcctcagggtgcccacttccctgctccaagttctggaggcgaggaggcaatggaccctgttgaggcagggcagtgccagcgtccatgtaagtccatctgtctgggtccctgagacccaagatgcagcagtgtgtggagcagggggccgccctgcctgacccgggaggtcctgcagggaatgcggcccaggctggtcgggtgagcaggccaaaggctgtggggtcagatccggaagctttcctcccggccatcgatgtggcggacgcaggtagacgtccgtgccaatgccctgcagggactgcagctgcagagacccaccgaggtactccgcgtaggcccgtgacgt

SEQ ID NO: 930 - DNA, 499 bp, Homo sapiens
  Genbank Accession No. AA421079
gcaaagccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtt

SEQ ID NO: 931 - DNA, 490 bp, Homo sapiens
  Genbank Accession No. AA421213
cgtagacagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttc

SEQ ID NO: 932 - DNA, 466 bp, Homo sapiens
  Genbank Accession No. AA421244
ttttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttc

SEQ ID NO: 933 - DNA, 363 bp, Homo sapiens
  Genbank Accession No. AA421561
gttttttttttacccctccttagctttatgcgctcagaaaccaaattaaaccccccccccatgtaacaagggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgc

SEQ ID NO: 934 - DNA, 412 bp, Homo sapiens
  Genbank Accession No. AA421562
tttttttttttggagaaaacagaacacccccaaaacatttattttttttttagaaaatcatggctcactatggtagtatacaatattgttttcacacatgtacacttgaaaccaaatttctaaaacttgtttttcttaaaaaatagttgttgtaacattaaaccataacctaatcagtgtgttcactatgcttccacactagccagtcttctcacacttcttctggtttcaagtctcaaggcctgacagacagaagggcttggagattttttttctttacaattcagtcttcagcaacttgagagctttcttcatgttgtcaagcaacagagctgtatctgcaggttcgtaagcatagagacgatttgaatatcttccagtgatatcggctctaactgtcagagatgggtca

SEQ ID NO: 935 - DNA, 312 bp, Homo sapiens
  Genbank Accession No. AA421638
ccattcctacatatatttatttggtattgatgatgaggaaccccgtcaaaaattcctgtaagggagactactactcgactgttaggggtattgcaacatttacatacatgtagcttatcacatacgtaaacatttacacaaatagtacagcggtgaaccaccaagttctcattccacattcctttcccacactgcgtttacctgcccattcttgaaactggatctcagggcagcacattgcatttcaacaggcctagtgctgcttctcagaggcagtcaactcaatggtgcaaaagcacaggacagcgacaa

SEQ ID NO: 936 - DNA, 467 bp, Homo sapiens
  Genbank Accession No. AA421951
tttaaggcaggagggaatttagtggagctccggaaggaagaaagtggggttgggagaacctccccaaccccatccctgctggcccggggacggtacgagctctcagcaagagaagtattcccgggatgctgagcgcttcattctgtctccaggactcaggcaggtaggtcccagctccgccgcgcccccggacctacaggtcagcgtggtccgaagtttcctctgggggcttcgcgggcgcccacacgtactcggggggcacctgcgcgtcgggacgcgccttgacgtagcaagccgagctcctgcactagcgcattgatctcttcgcgggtcatttcactgagtgggatgcgctctagttcctcgtagcggcggcccagcagcacgagctcagggtcggccccagggaggtgtttcatcaccaggttgtgatagaatggaatgtcctgcgtgacgaaagccttcac

SEQ ID NO: 937 - DNA, 668 bp, Homo sapiens
  Genbank Accession No. AA422049
ttttttttggtgtttccagaagagaaatttaatctaatttacatacttctaggtacatcgataaccaaaatgtggccactgaaaaaagttaaaaggtcaatcagctcctggcttctagctggcccaggattgcaaaataaaaagatccacgttccttattctctacacaaaacgcgtttttaaaaaagtgaaaggtctagggagctatacatagaaagcaacagtgaaaacggagagggagcaggagtaggggaggagagtcccactccccaaccccaccctccagggccccagagcccctgaggctctttggggggccttgacatggcaggaggcagctgtcagctctgagctcttcccagctgggaaggcccctctcggggcgagccaacaaggatttccgtggcattgtgggctcagtggggggctccaggcccagcaggccccacagagggagcgtggcttccctgagcaagcaccgtggcatgatgtggtcgttaacccaggaactgggggtccggggcatgtcccgggtctcacgagtcattgttgggttggttggaggagtgcctagcgcaaggcagcccagtttcgcgaggctgtcggcgcgcgcggcccgaagcacccgggaagggcttgccccgagcactcggaagcgctttccgcgc

SEQ ID NO: 938 - DNA, 366 bp, Homo sapiens
  Genbank Accession No. AA422086
taggaagggattccttggggaccactggatgctggtagttaaatgccaggagctgaatggacctgaagatggaggagactctgcagtcttggtcagccacccttggggcattgccaccttgcactctagcaggattgatggtctctggatttgtagctgtgaccggtcatggtggaatgctcggtggtttgcactggagaggcccacatggtggcgactgaggccctgtgggttgaggttggctcatgatagctctgaaagttgatggcacaattgagacaaggacgtggagttctggaactttcccagggtccttgcagcccgagatgaagccctccaacattgcagctcactgctgtgaaggct

SEQ ID NO: 939 - DNA, 245 bp, Homo sapiens
  Genbank Accession No. AA422150
gaaacaaactttaattcccaagccggacccttaagtcacaaggaacgtcagatccggctcactccctgacagggtgaattggaaactggcccctacttggtctctaaccccttccactgggtctagtggggactctgacgccgaacaggggctgtagatcagtgagtgtgtatgtgtgtgtggaggggcagcaggggccgctttccacgtggttacataagcacgtgttggggttgggccggtgt

SEQ ID NO: 940 - DNA, 357 bp, Homo sapiens
  Genbank Accession No. AA423820
aagttctcagcacccattgtaatttatttgtgaatgaatgggaaaagggtatcagtccaaggggagatcaggtggttcctcctcatcagagtcaaactcaacattttcatcttttacccatcgacctcgtccatctgggatccatccagagcttcgaagggtgagataatggtccagggctcgtcttcttgtggggctcatgggtgcaggggctgagacagttgctgactcctcggcctgtgggcagccgcaggttcaggttccctactgatcttcccactttggagtttgacctctgagggtggcataggggaaagggagacagagggaccaggggcttctgtacttccggcggca

SEQ ID NO: 941 - DNA, 304 bp, Homo sapiens
  Genbank Accession No. AA423827
gaaaaacaaactggtttttattctaaacacgtactagggcagcatgctggggggcctctcctgcctccagaggtgcccctgctccccactgtggccctctttagacagagtaggagctcgggctacccacatgcagcccagcccttagcacccaagggcctgcctgtgccccactctctgcctgggctagggaggcccaggaccctcggagtgggcaggcccaccctttccatgggtcaccagggtctcagtgcccacttgtcctccaaccaacagtgacacggcaccctccacacggcctgtg

SEQ ID NO: 942 - DNA, 214 bp, Homo sapiens
  Genbank Accession No. AA423841
tttctcgtttccccgactttattcagtggcacgttcacagcggggatgggggtagacacaaggtggggcctgatctgtcctggagccctgggggaccacacaccatgcactatggatgggagggggcacaggaggggcttggtggcccacagaagcctgtgtaccagggaggaggcggtgagtgcctgggtccccctagcccaggcccgcaatg

SEQ ID NO: 943 - DNA, 452 bp, Homo sapiens
  Genbank Accession No. AA424029
ttttttgagggcaggtaaatgtattcagagcacatggcgagtaagaggcaaatcttctgccagcaagtccaggatttttttcaccagaggacattgcttggtccccagggctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaat

SEQ ID NO: 944 - DNA, 484 bp, Homo sapiens
  Genbank Accession No. AA424307
gcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgcgttctaagctataacagtcgactttattcttctactctgaaaaatcttgacttgtttgagtgtatataatatatat

SEQ ID NO: 945 - DNA, 310 bp, Homo sapiens
  Genbank Accession No. AA424487
tttttttttttttttttttccaaggacaagagtgtctttactggagttgggactggggcctctataggggcttctggtttctgggctgtaggtttgtgaggtgtgggatcttaagtcaaaggtgggggactagggcagggtatcagaaggtgatgtcatcctcgtacagggacagcagcagcaggacggtccagccgcccagcaggcccacgttgtgcagcaggaagaggagccagggccgcgggtcccgtactttcaacatcgccgggagcatgtcgcagagtgctacgtagaggaacaggccggtggc

SEQ ID NO: 946 - DNA, 226 bp, Homo sapiens
  Genbank Accession No. AA424672
ttttgtggttttaattgtggattttattagaagtgtgatactagtcagaaaggcccaggaagttggcattgcagttaccagctcagggagaaggaaagagagcagcaggaacttctataggagacccaacggaggttaacataagtggacaccctcctgtcccctggcccctttcctttcacccagatttggtatgtggcaaatctaaacatttgcaaattcacag

SEQ ID NO: 947 - DNA, 423 bp, Homo sapiens
  Genbank Accession No. AA424798
ttttttgaaattttagatttctttatgttttaacaaattaacaacaatgataagaggacattagcagcttttcttgggtctctttgttaacaataactcgatcctgcagccataacaggggatgtggccaagttttagctggcagaccagtaagccaatattttacacaatggatgacatttctgaaagcagaggcagagacagacccaaagtcacacatgtagtccaacaaacaagtttctgccatttttaattgtatttagagcaacaaaagattccaagattacaaaaagagaacagaacactagcgcttggagctggtcctgctgcccagtggaggccaagtgccaccgtgagaaataagccccatctaaagagatttcaagcaaaattgtttcttttaagaaaatctttgtgtgatgc

SEQ ID NO: 948 - DNA, 411 bp, Homo sapiens
  Genbank Accession No. AA424813
tttttttttattctctaaaatttatttacagttaataagttaaaaagcaaagtacaagcagattataaatctcaaccataagcacatcaaactgtccagggaaacactttgattccattacaaacaattgttttctaatgcgcttaagacataacactctatcaaaaaatattttaaacacaccaataaatattaggcatgtatgtccattaaaaaccattaaagagtcctgtggcaatccttaaaacaatgaaaaacttttgagttcaaaattgctcagatattttgtattcaaatatttttaaaatttacttaagagttttctaaaaaatagtactatcatttgcacacagcagatcaataggtgtcagtcaccagcttaagttacacttgtcaatattcaaacttgaa

SEQ ID NO: 949 - DNA, 252 bp, Homo sapiens
  Genbank Accession No. AA424881
ttttttttttttttaaaagcttcaagatgcttttatgtcaagggtgtggggttgccctgcttggcctgcagtgctttggggccccatgtggtggaggggtgggcaccatggtacccaccaccctgctgcctgggcagaagtgcaacatggcacacgatgcctgggggatcactccccccagggactcatggtcagtgtccactcacaaggcctgcttccctcatgacatctggccagtgacacccacagggg

SEQ ID NO: 950 - DNA, 512 bp, Homo sapiens
  Genbank Accession No. AA425214
tttttcaactttgaaaatttctttattacagacatttcagaaccatttaaatcaacagacaaggaaatttttagacataacatactgtgtttatcttgaggtacacattgggcccattagataacgttttggaaagtaatgccattgttaactggtagttaacaacccaagttttccaagcaaagaaactgtaaagatggttacaaaattctttgaaaagaatacaccatttccatttaagataaactctccaaattcttaactgatttcaatttttaggcttagcttaaatattttaaatgaaacaatatgagagtgggagaaaaggtttatagctaagaaattatctgagccccactacatgagattgtaaacaaaggaaatttgcgatctgataagctctattacaaaatttatagcctaaaaattagagcagcaaaattacagaagatatttgtatatagtttaaactgaaatcacgtttattccttgtttctggctatcacaatgag

SEQ ID NO: 951 - DNA, 537 bp, Homo sapiens
  Genbank Accession No. AA425279
tttgcagtgggctaccattattaagcacttagtgtttgcccagcatggtacaacaatctggtaggtgggtagtttatctccaatgacacatggggacaaggggataagttatcttgcccaaagtcacacagccagtgagtgttggaagctggattcaaacccagacgtcagattccagagtccattctcttcaaggggtggccactgcaccttggggaactgggggtcctcgctgggggcacctgcaaggcgagcattgaccctgttgtggctagaccagagccagaggacagcggcgttgggactccccacccggtgcatggaggcagcagccatctgctcgaagtggctagcgcagtctcggcagccgaagaagtagtgcacgtagcctcggatggctgggaggacctccttggccttggctgcttcctgtgagtggtctacattttgccgagctgcctgcacagtcaagaagtggaagaggacccacagggagcagggaaagccccggaaattcggctcaatccctctgcaaga

SEQ ID NO: 952 - DNA, 335 bp, Homo sapiens
  Genbank Accession No. AA425294
tttttttttttttttttttttaaaattcaacagctttattgtgaaagaatccagagatctcacactgaaaaaatactaacacagctcatatataaattacttatctataagaacaattatagaaggaatctaaatggggcaattttaacaaaccaggcaaaatatcacatatacctgaatataaggtaactccaagccatgagtataagattaaggcagttactttattttgaacaaggaagtggcataagcaactcagtgtgtgccccttagggggggagctcttccccctaccactccccaccccaaggcatcattttggagaaaaaagtgtc

SEQ ID NO: 953 - DNA, 469 bp, Homo sapiens
  Genbank Accession No. AA425309
tttgttttttgttttttagatttcaaggcaaggcacgtaatgtggacattatatcttcgtgcaaattaggattactggaaagagtatttttaattaaaattttaagagacatagaggcaaaatgtgtctgcccatgcacactatggatctgtcaatacaagaaatttgttgaacaaggctaatgtctgaaagcaccatgcaagttttcagcaccctgattacatttgttttctcaagagtgcgtttttatatcctacaccctggcgttcccagtttgtaaactgtaagctttacccttgtgacatggatttgcctgcctctttgtctctataatgcagattttatagaaccttttgtacaccctatgggttcttgatgcaaccagtaattttaaataaataaattctacctccaaggaggctgcagctaaaccaacataagtgctgtgttttcattaattttatttttc

SEQ ID NO: 954 - DNA, 424 bp, Homo sapiens
  Genbank Accession No. AA425401
tttatggcctgtcgaatatttactccactgacgttatctacagaagcacttggccagtttgtacacagtgattccttatgcacgccgaaagggtttccgtaaaaatgacattatatacaaatctgtacacccatccaccagagcgattctccagctcccagagggagttatcaacttaaagcaggatacctgaggtttcatgtctttagttgccttatcataatcccaaatatacatttcagggtttgtttttgtttttaaagacactttcctggaatatgtgcactatggttaaaattaaaaacaaaagtaataaaataaaataaaatgatcgctggaaggagctgaccctccccacccatctgagagacttcatctggctgcagcacagtgaagactgtgtgtgtccctggacgggcgcctg

SEQ ID NO: 955 - DNA, 316 bp, Homo sapiens
  Genbank Accession No. AA425544
gaaccttcaagtggcttttattggtagagcctagaaaaagtgtcatagccatttctgagcaaaaatctgtatcccagtaaggtattcagtgttatgtttaacacactactgaaccagaaagtttaagttcctgacacagacgcaaccaggtcactaagaggctccaaaatcaacaagttaagccctgctgctctgttaagatctgaaaggcaagacacagtgctggatgtgtgcccttgttacggggtgactaaaaaggcaggcaacagtatcaaggattttttttttaggtggactcctgtgcactcccacattg

SEQ ID NO: 956 - DNA, 412 bp, Homo sapiens
  Genbank Accession No. AA425782
ttttttttctataaaaatataactctttattaaataacatgcacaaatatcaactagtcattaaacagatatttagaacaaattgtaaagaaatacaaatccttaggtacaatttagtatcttgttcatgatatttgaagagtttaaaaagaatcactgattaaactaaccatcctttttctttctgaatccaaaaccttttcaggcatatactccattccaaatttttttctagcatttcagagcttcagaatatctttaataccaaaagcccttaactacttatttgattatacatttccaatgagaaggcattaacttttcttttaagctatcattagctttgagtctctttataaaagaaatttgtagaagcataatcatggcagagaggctccagctttttgaggta

SEQ ID NO: 957 - DNA, 368 bp, Homo sapiens
  Genbank Accession No. AA425836
tgacagataaaaacactttatttaaaagtataaaaccaggcttactccttcaaactgctcccacccctaattatctccacaaagagctatataaattgggcaggggtatgtgtacagtcatctcagctctaacaaccccagttcttctttcaattctcctttctcccttcatacaattgagatgtttgtcctttgcactttccccaagatagcaaaggtgatacaaatgtggaaggaggggaagtgtagaaaataaactgtcatcatcctctattcccatctccagggaacagacagattatatgaactctgaccaaatgatttgcttgtctgaagaaacaaataataggtacagttactctctgtat

SEQ ID NO: 958 - DNA, 403 bp, Homo sapiens
  Genbank Accession No. AA425852
ttttttgttggcatattattattagtttattatttataccgtgctctgttccaaaaaggatgtaaggaggcagcatggcttgagtaccaccttacttgatgagttaaggagttcacatccatctagagacacttgtctgagagactgtattagaagactacgggatggtttaggggagggaagagtgctaagaaaagcagtggcatcttgtccaacctcatcttctctctcctcatttgcaaatcatatctcaggagtaagccaaaaactggtgggagggttgcagcaggaaaaaattagcagtaaagcaggagagggttaattcttagaaaggtacacaatcccaccatccttcccacctctggtgcctactgcaagtaaagagtctggtcttctcccgaca

SEQ ID NO: 959 - DNA, 416 bp, Homo sapiens
  Genbank Accession No. AA426156
taacattctacaagtatttatttcattgctgaccattaggttgcagcatgaactctcaacattgagctgcccctctccactcctatagaagctccaaatactatggtaccactatgtaggttttcagcctttcaaaggcttttattattaacatcatcattacttcagcaggagccttttagggacttaaaagcactgattatctataaaaagtaacttcatatttcatgcacaaaattcccaattggcagatttaggtccataaaagaaaggaaaaaaattattctagttatataaattatcaggaataaaatagcatttctccttgccttgttataaggaaataatatatttttccttaccaggaatcaggatagtatctttgatgatccctcagggttataaaattgcttact

SEQ ID NO: 960 - DNA, 499 bp, Homo sapiens
  Genbank Accession No. AA426168
ggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgcactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcagggagggcatggaaggcatgtgattcaccgatgggtccctgagcagaga

SEQ ID NO: 961 - DNA, 330 bp, Homo sapiens
  Genbank Accession No. AA426291
gatatttccatttattttactttgagtaataaaaatttttctatctcatacatgatcgaacacataagttgctttaaaattaacagtcacaattgaagaaacaatggtttatttttctaatcaagtgaccaagctgctgaatcataaggcctcaacaaatgttgcatcttattatttcactgaacaataagaccttctattgtgattattcctggtaaatagcaattttgtttctccagcggtttccatttgccaaacagtcatgacagatggttgaacatggtggctactgctttcaggggattctatcagatgagtcctcatttccaa

SEQ ID NO: 962 - DNA, 395 bp, Homo sapiens
  Genbank Accession No. AA426304
gtcagccaaaacgtggaggtgtccctctgcacgcagccctcgcccggcgtgggctgacactgtattcttatgttgtttgaaaatgctatttatattgtaaagaagcgggcgggtgcccatgctgcccttgtcccttgggggtcacacccatcccctggtgggctcctgggcggcctgccagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcaaaaaaaaaaaaaaaaaaagat

SEQ ID NO: 963 - DNA, 421 bp, Homo sapiens
  Genbank Accession No. AA426330
aagtttcttggaaatttttttattctccttgccaacatttcttttgacattttattacttaattatgtgacattaagaaataatttggttgcatattattttcaaaaagcagtaagaaagtagctattgagaaagaaggagggccataggtttttcaataaaacgttagaaacattataaaaaacgagactcccattacatggaaacacatgatcaaagatcagactaacacacattcaaacaggcttggttcgaaatagagttctccatttctttcagatgagccttttttcttaggctctttcagaagcacttcacaatgaacagaggtcttgccagctcatttcattagcggagaagcaaaggtatgatggcagaatcatgagaagatggaaataaggcctgaggatatggcttgatc

SEQ ID NO: 964 - DNA, 486 bp, Homo sapiens
  Genbank Accession No. AA426374
tttttttttttggttttatacagaacctttaattgcaaagaacttgaaagcagccacgctggtgggtggcagtggagtggagaacccaccacaccctcccctcagtattcttcaccttcttcagcctcggcttccacggaatccacgcccacctcttcataatccttctccagagctgccaggtcctcgcgggcctcagagaactccccctcctccatgccttctcccacgtaccagtgcacaaaggcccgcttggcatacatgagatcgaacttatggtccaggcgagcccaggcctccgcgatggccgtggtgttgctcagcatgcacacagcccgctgcaccttggccaggtctcccccagggaccaccgtggggggcctggtagttaatgcccaccttaaatccagttgggcacaatctacaaactggatggtgcgctggtcttgatggtggcgatggcgcgttgacatctttcgggaccac

SEQ ID NO: 965 - DNA, 257 bp, Homo sapiens
  Genbank Accession No. AA426447
ttttttttttttttttttttttttttcagcaacctcggctgtatttattgatacaaggaagatcacccgagagtcagggacgtggcggcgaggggccctggaaatctccagataccaaagctggaagggcgtggagtcttctccagttctcctagtttacagatgttgtgacctaggcttacaatgggcctggggtctgaaagcgggacgtgggctgcgggggtcaaagagccggtttggtggaggtcagcgccaca

SEQ ID NO: 966 - DNA, 280 bp, Homo sapiens
  Genbank Accession No. AA426468
tttcaaccaatgagtatttattaaaagccagaggtgcaccaggcacagctgtccactaggccaacagatacaaacgatgtaaccaattcgcttattagcttatctgattaaataaaatacatttcatagaaatgattatcaaatgcattgcagatagaaacagaatatcctttgtacttacagatcttatgataccctaaacaattattaataaaaaccagccaacccatatggtaaatagttagcaaaccaccagttattttattttagtcagcaaagg

SEQ ID NO: 967 - DNA, 295 bp, Homo sapiens
  Genbank Accession No. AA426521
ttttggatctttacaaagataatctttattcataatcacaggccacaggggtgagacctgaggtttgggttctgtggtgaaggagaacccctgtcctcctgtcccttgccctgggcctctgctggctgaggagggacaaggtgagggggcccccatggtgctcagacaaccagagcctccctggcagggcaggagtgtgggtgccacagagacaagccccttgcagagctgacctggagcccaccatccccatagcctgtgtgagcatgaagcgaggacccccgggtgggctgtg

SEQ ID NO: 968 - DNA, 362 bp, Homo sapiens
  Genbank Accession No. AA426609
taagcagaaaaaaactttatttctatcaaattgaaaagtatgaaccttcaagcaagataatcaacataatcaataatacaattaacagttaggatagcatatacagatcagactggaggtttagatacttggaagcacatacaccaaaattaagagggccagcaactgtcccaccgaggaaaagcactctgactcatcataaacacacgacttctgggaaacttgagctgacatttcacaggacagtaaaccaaagagacaggttgtcattgggttatagaactgatctgagcttgagagggatcacagtgaaatgccattgtaactcaacaatttccccagagatctgttcatctcaaaaa

SEQ ID NO: 969 - DNA, 404 bp, Homo sapiens
  Genbank Accession No. AA426640
acatttcaaatatattttattactttccatcttagaaagaatatgaaacctgcatgcaatgctaatggtttctgacatgtacatagcatataacacagcagtacaatgcggcatatactggggggcagtgtgtggagggggcgttcttaagggtatatgtacagaggaaagggcgcatggtcatcttagctttcgaaagaggactgcactgtttaacattgaagaattacatggggaatcacaaatatattgctttagtactgcatgttctgttgtggtgagggaaagaaacatgctttgaaggttttcccttgtcaacagaatgtgtgtctgtagctgtgtattgcgcatgtattcatatatttttaagttttctcctaaggtttttgctgacagtgttggga

SEQ ID NO: 970 - DNA, 418 bp, Homo sapiens
  Genbank Accession No. AA426643
ttacatgtgtcaacactttattataagataggttttatgttagatgataacaccagcatcttgctcaataaattgaagccagctttttcaacagagaacattattagaatgaaactagatgcaagaacaggaaagtaaacacctgtgtcatgttcaacaagactgaactacggagcaaagaatcacacagtgttgcaagatcttgaactgactagatgataggattacaaaaaccacacagctattgctggaaaattatgtcatgcagagaacagactggcacgattacatatgtgggtttgtcctacacaaatcagacctttaagtgaaacaagtctatccaaccatcttcccataaaacctagtttctatggaaaacaatcaattaagctagacccccacattttagatgtatatt

SEQ ID NO: 971 - DNA, 409 bp, Homo sapiens
  Genbank Accession No. AA427442
tttttttggagttccaggtttttaattttccctgaattttttttttaaacaacaaaattggcaagaagaaaattcttcgacatttgggggctggtcgacatttgggggcaagggttccactgaaaaatcccccaaattcacgctgaggtttcaggtcatggttgctgaggtggaagatgaggtcagggctcttggagattttccaacccaccctagaacttgtttctaaatggctggggaagaggtcagtataggtccccccgttactgcagatgaaggcagaagtcattctctcccccacccctcaacttcttcagagatgtggagataggaggcttcgatctctaattgcctacgatctcttaaaaatataaaacacgtgcagttgactttggtacaaaaaagaaaa

SEQ ID NO: 972 - DNA, 408 bp, Homo sapiens
  Genbank Accession No. AA427460
ttttttttttggcttcctctttctttattgggcgctttgtagatgtcacgcaggtctaaaagttacactgctaaataattatttaaaaactgaccaggacgaaggtctgctctggtagctccaaaccagaagcaaaaaggaatcggggcggtgggctggggggtactcctccaacatcaccaaaacccagaaaacgaggatcctaagctcctccgcaggccaaatccagggcttgggccactgggctaacccgcaggtgcctctgactgcatcacactcagagtaagataaccagcaaggggctggagggaacggccagccgagtccagacatggacagatgtaactggaaggaggacaggaaacagacaggtactgtccagctgtaggtaagagagtgcagctaaga

SEQ ID NO: 973 - DNA, 313 bp, Homo sapiens
  Genbank Accession No. AA427468
ccagcagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggttttcctcttccttctttgtggtttctgttttgtaatttaagaagagctattcatcactgtaattattattattttctacaataaatgggacctgtgtacaggaaaaagcgaaaaaaaaaaaaaaaaaaaacc

SEQ ID NO: 974 - DNA, 203 bp, Homo sapiens
  Genbank Accession No. AA427537
ggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcaggtatgggccagaccca

SEQ ID NO: 975 - DNA, 424 bp, Homo sapiens
  Genbank Accession No. AA427579
tttttttttttttgcagaataataataattattataataacagtatcatacatcaaggacaaacccagctgccccaagcctactgcaaaatctgtatgtacagtatagtctatgtgggtggggtacagggctgcctgcctgcaccctcaaggccttactcataccagcttcctgaggaggggccggcccctcctcttgcccctgttgaagcttggcacaggctggggaggctggcactgccaacgccatccctccatgttgggcaagcctgttccaaggggctggactcacctcccccattgtggcctggctgcaagggattgggggtgagcttgttgagggacaaggcggtggcagctgtggggtgtgtctcatctgagtcccctttccacccctaccggctcttcctgcgggcctgccatgg

SEQ ID NO: 976 - DNA, 439 bp, Homo sapiens
  Genbank Accession No. AA427636
tgggagtagtgtctttattcattaaagcctgaggtctgaccacccctgtaaaacctcgtgcccacacagtgcctgtctgagtccttctgtgcccaaatgtggagcaggctgcagagacttgaagcctggggttttgtgcctcctttttgttttgtttttttttgagacagagtcttgctctgttgcctaggctggagtgtagtggtgtgatctcggctcattgcaacctctgcctccagggttcaagtgattctcctgcctcagcctccagagtagctgggattacaggtgtgcaccaccacgccaggctaatttttgtatttttagtagagacagggtttcaccatgttggccaggctggtctccaactcctggcctcaagtcatcctcccgccttagcctcccaagtgctggaattacaggcatgagcaccacgccc

SEQ ID NO: 977 - DNA, 370 bp, Homo sapiens
  Genbank Accession No. AA427734
tttttttgctggttgaattgtctttattaacaaacaggatatccaaggccactacattgaggctttgggctgggggatggaggagaagggttacttgctgctcacactatatacagatgcaagcaaggggcgtggagagtgagggctccctgctccctccctccaccggggaagggcatgggctagaagaggagaggggggtcgggaatggggggaatgttttggctggcgggttcccccctccattccctggagtttgggggaaggggaatcattaaagtgctttcagaaaatgaagaaatggtccctgcccctggagtggctggtgaccccccaaaaatctagggcccagtgaccccccccagggtct

SEQ ID NO: 978 - DNA, 327 bp, Homo sapiens
  Genbank Accession No. AA427778
ataggtatatatatatattttttgccttggaagggagaaactcatatcattttttgcaatcataaaaataagcaaaataaaataaaaacatttcatgctcattaaacaaattttagccaatagagaatagtggaaaaccaaacagccaaaatcttatcaataaaaccacctctgtttagtattttgagagaattattattatatttttggagatggggtttcactatgttgcttaggctggacttcaactcctgggctcaagcgatcctcttgcatcagcctcctgagtggctgggggtataagtgtgcatcattgcacctgccttt

SEQ ID NO: 979 - DNA, 444 bp, Homo sapiens
  Genbank Accession No. AA427783
tagctctaggtgtgcccctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagat

SEQ ID NO: 980 - DNA, 281 bp, Homo sapiens
  Genbank Accession No. AA427819
ttttcatgaatacatatatatttatttaattcataatatagcattttggatgggctggaatattgtagagagggatgaggctgtgtaatccacagatgctcatatttctgtcactaggagagacactattggtccagagctcccaatacaaacaggcgtggggtaaagcatttgataaaaaatagtccaacaatagtctaataaatagtctagccaataacaacaatacagcatatgtctgaagctggcagactacaccataaaaggcagttttgtctgac

SEQ ID NO: 981 - DNA, 324 bp, Homo sapiens
  Genbank Accession No. AA427825
tttactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaaggctggtgttctccacttatttcagcgacaagctggggccaggcctcaggggcacgcctggggg

SEQ ID NO: 982 - DNA, 446 bp, Homo sapiens
  Genbank Accession No. AA427925
ttttttttttttttagatttctcatagatttatttctgcgtcatattatatatagatatatgcatatatacctttttttttttaatacaatctatatacccttcccttccccaccaaactcacaaaaggagattaaacccttccaggattgccatcaagcttcccgagatggccagggcaagaaagaatcatctctcaacatgttaagaaacggctgccattcttaggctctggggttgaagcagcagcattcccaggacccaagggccagagagaggaaaagaaatgactgtagtgtgacaggattctaggatgaacatgtccagtgactcctggcatggcagactggctcccagaattctcagggtgtgagtaaaggtgggggccctatggctcttcagaggctgctcaataggtcaggggtagggtataggaactggggatca

SEQ ID NO: 983 - DNA, 379 bp, Homo sapiens
  Genbank Accession No. AA427946
tttcagtttttggtcattttaattgtaaaaaccaagacatttatataaataagaccgctgtgtaaaatacgattcacccttctactaaaacccttttcccacactcgaaaagaacatagaaaacccagcagagagcagtacaaatcagcatgcggtccctgatgcgaagtcgcgggcaggccagggttccctgcggaagagcctcgtggtgagagcactcctgcccaggtgtcccaccagaggctcggtgacccctcgagaaactgccaggtagcagctcccacacaccagcccctggctctcaactgtacgggtcgaggaggggacgggaaaggctgcttggtccccaccaaggctgggggctgggggggctgctggc

SEQ ID NO: 984 - DNA, 452 bp, Homo sapiens
  Genbank Accession No. AA428006
ccttcgcggggcgcggccgagcttttcggttcacagcgggcagggaaagccgcgggaagggtactccaggcgagagcggaccgagtgtcgtggcaggaaaagtgactagctccccttcgttgtcagccagggacgagaacacagccacgctcccacccggtgccaacgatcctcggcggcgatgtcggcccggtgcccgaggcctgcgggcacctaccaccggctcctcgataaagtggagctgatgctgcccgagaaattgaggccgttgtacaaccatccagcaggtcccagaacagtttttttctgggctccaattatgaaatgggggttggtgtgtgctggattggctgatatggccagacctgcagaaaaacttagcacagctcaatctgctgttttgatggctacagggtttatttggtcaagatactcacttgtaattattccaa

SEQ ID NO: 985 - DNA, 535 bp, Homo sapiens
  Genbank Accession No. AA428150
ttttttgtctaatacatgtttatttcactgggatggagagcaggccctacttccagggaacaggttgagatctggagtccctgtagggtcagagctagaggacccagaggaggaagtcctggaaggccttcctggaggaggggctgtcagagctgagtccaaactgaagaggcatttgcaatccaggagaaagcgacccctggtagggggagctgcaagaggaaaagctgagagataccaagaaatgcaagggacctgcatccccatgcatccctctgcccatctgcaggggcacttagaagtacacggagccctcgctgtctccttgggtcatcgaatttctggatctgagtcttgagatgcctcagtttacccttcaggtagtggcagcgagcctgcttgtccaggaagccaggatccattcgcttcatctcaaactccctccaaacccgggctgcaacttgggcctccttctggctttggggtgggggcagggagctcagcagggcctccagctgcctgagctttgcctgtg

SEQ ID NO: 986 - DNA, 187 bp, Homo sapiens
  Genbank Accession No. AA428172
ctgagtggtactttctcttcctggtaatccctggcccagccttatgcagaatagaggtatttttaggctatttttgtaatatggcttctggtcaaaatccctgtgtagctgaattcccaagccctgcattgtacagccccccactcccctcaccacctaataaaggaatagttaacactcaaaaaaa

SEQ ID NO: 987 - DNA, 396 bp, Homo sapiens
  Genbank Accession No. AA428204
tttttttaaaccacatactttatttgatgtcaacatcaaagaaggaatattttaaaaagcacatagaaacccttaagttagtaatattttaaactgcatgaaaaacatattattttacatcttgtcatactgtatatacaactgtacataaacttctgcatttcaaagcacttgtcatttataaagtgaaaagtttgaaagtgctaaataaacatttcctaattattatttttaaaaacagcactcttttggaagttatctcttctttgtgcttatagttgatctgcaaacatttcaagtcaaagtttctggaaacttctttaggaaacatctggaaaaaatcatagtagacaagggctaagtgcagacataagcagctccattttataaacaaaa

SEQ ID NO: 988 - DNA, 159 bp, Homo sapiens
  Genbank Accession No. AA428325
tttttttttttgcacggcttatttcctttaatctttgcaacaacccaaagtataatagtaagcacagggtttttgcgtgatacccggtaggccttattaagaattagctcttattttcatcaaaggtagagaaaatgagtaactattgaggcccccgct

SEQ ID NO: 989 - DNA, 436 bp, Homo sapiens
  Genbank Accession No. AA428567
tttctgctttttaataattttattttttttctaattttgttaatttcccatagcaccttggcgatgttgaaaacaaatacaaatacaaggatgtactcattttaacattttatgagcatgtgtcacaccaattttgggggtaacagttttgacaacaggaacaaatctaagcaatcgacaaaacagaagccggataactggctctgacccccacccccaacatttaagagatgcaaaggacacctgaattaggttaaaaaaatcaagttgatatggatatttcaacagtgttctgtgctgcaaaactgaaaataaaaccatttaatacacagcccattaatatctgagttacgcttttaggaactgtcaactcgaagattcataaaaagttgtcagcttttaaaaataaactttaagttatctaataatcaggtga

SEQ ID NO: 990 - DNA, 389 bp, Homo sapiens
  Genbank Accession No. AA428607
gcagaacaacatgcttttattttaccatcatgcataaaaaggaagacaaatatgccaatggtacacttccaatttgtcagagcaatttcacagtatttaagcaatttaggaaaaaagatatatcacttactaagttgttaccagggaaaattatcatgtaagacaatcaattaaaccatacttttgtagattatttttccatgaaggcaatttgacaagcctaacaaagaccaagttgttcaaactatgtttctaggaatatagtttaacagaaacaagaacaagttgaaaactgttatgactattcatatgtctctatattgtacaggcaagtaagactgttgttcttccaaatgttcccaattgaaatcaaaagaatatctgtacag

SEQ ID NO: 991 - DNA, 265 bp, Homo sapiens
  Genbank Accession No. AA428863
tttttataatcaacctataaggatttatcaataaataaacccttatttattataaggaattggcttacacaataatggaggccgagaagcccaaagtctgctgtccgaagtctgagaaccaggagcactgatggtgtcagtcccagttcaagggcaggagaagatgggtgtcccagcgccacagtcaggcagaaaattcaagcttcctccacctattttatttgggtccttagaagactggatcaagcccatccacactggggac

SEQ ID NO: 992 - DNA, 454 bp, Homo sapiens
  Genbank Accession No. AA428900
tcacggctgataggcttttattacagactgggggcggtaacggctggacagagaacggaaaaggaacatctgagaccaggctcaaagctagggggttacacaacctccaataacacaaggtgagtgcagcacttctagacacacacacagacacacatcacttactcataaacggcacagcctacggtacaagaaaaagggcaaggtaggtaagggcacccaacaccctcctgcctgcagggggccacagggttaatgtgccttcctgcacgcaggcttaagagggataaacaaggagagggctgcccttggagaaggcctgcggataatagtgactgaggcacaggtccatgcaggggaaggaagcacagttcacagagtggcaagctcagtgccagccagtgcaagcaacaggcagttctttgatcctggcttagtcacagcaaacatttac

SEQ ID NO: 993 - DNA, 396 bp, Homo sapiens
  Genbank Accession No. AA428964
tttcagatcacgacaacaggtaacctttagtcagaactcaccacccactgtgttaagccttacatgacaatcaccatgaagatttacatacacatgttatatcatagtctcctcacaacatgtctaagaggtaggcacgtcattgttcccattttgcagatgaggaaactgaggttcagagagggcacttggcttgcccaaagtcacacagcagggagtggcagaggaagtcaggttgggtgaccccagtaactgctctcagaggctgggtgatgaccggcttcctggcttctctggaataaacctttgccaccacttcctgcatttcagcttcagtacaggcagagaatggggataggtgggggaatgaggtgagaggggagatgtttagaggtg

SEQ ID NO: 994 - DNA, 305 bp, Homo sapiens
  Genbank Accession No. AA429009
tctccacaaaccacttttattacccagtgggtgggctgggctgtgatgttggagaaccttgggggtgggggctgcggaatgcagctgagcctctcctggctctgtctgctggtctaggccagggtggggctgatcaagggcagagagctcaatcttgggggaagaggaagagaggacagagaggccaaacaggctcttcccctcctcttcacccatgccacagcattaaataaacaaaaagcaactctttacagcacaaactacacagggaagtccttcctcccagccctgggcgcacagcatgg

SEQ ID NO: 995 - DNA, 295 bp, Homo sapiens
  Genbank Accession No. AA429038
tttttttttcagttttaaaaatggcttttatttatataagtcattgcacattcctaatacagtgatttcctgaaaattacagtattttgtaaacataagatttacagtttaaccatacacaaagcctatttttttatttcttgacagaataaattacttttcttcaaaaaattagtcaagtgcaattttgcccaatatttaatgcatactagaattaaagcctatgaaactaagtagtaacagatgcaattatcaaacctttcatttgaacacattcactttcaaattgaacttc

SEQ ID NO: 996 - DNA, 423 bp, Homo sapiens
  Genbank Accession No. AA429470
aattgtttaagccaaacatttaacaacatacaagagaccttacaaaaagaaggaggtaagtcctaatgctggagaattggttaatcaggtgactggcaaagaggaggatgaggcctaggaggaagtctccagaagcattggaaaccagacagtgtcagagcctctgacctgcaggcgggaggccggtggtcagtctgcacagtaccccttgggaagccggagttccggaagcaaagcgcttggagcccgccctgcacgccgagtccccagactctgacaggtccccacagccagctgagaaaggtctgttttcaaagcatgcgggcagcggtttctaaaggaatcccagcagctcccacggcatgtcgggcagagcgtggcaggtcgagtgaagtcccaaacatcccagaaagagagggaagg

SEQ ID NO: 997 - DNA, 435 bp, Homo sapiens
  Genbank Accession No. AA429472
ttatttttgaccaccaccacgattttattcttaaataaagctcagtctaaggccaggttaggtgtacaggtaggtgaaaggggaggaagtgcagatcccgggcacttccactgtgggtgagtgggccagcccaggggaggtggggcagctgagaaaggcaagcaggtacacagggcaggaggggacgatggaaccactggagtcattctgcatgtgctgggaaggtgcagaaagaacctggaccccacgttctctgtgggtggtgccaaaaagctcagcatggtcccgagccccaagagtcccctgcccggactccccctgtccagctcagtgcagcatcaaccaggcagtgatggctgcctgctgccattaagtctcccaacaaaatctcaggttgaggggcggcaaggagagccacatgcctgccacccacgc

SEQ ID NO: 998 - DNA, 435 bp, Homo sapiens
  Genbank Accession No. AA429478
ttttcttttcgattgacaaccttttatttttcaacttaggtaacagtccaaaatcagtgtagattggcgaaaaactaggcaaaaatagcaaaaagtgcagtttaatttagcaaaggctcaagacagtatgtggaaggaaggtgagatttccctcctactgcggcaaggcaagcggcagttactgcccgacagtaacgatggtgtgcgcacccccgatgagaatgctgctgcaacacagactgggacgccgcctcccccattagacctgccagctcattcgtgaaaatctaccaggaacacatcaatgaaaaaaatatgtcaaatatgagttctctgttataagcaataaaatcacaaaatcaactcagatttgaaatttagggtaagctaggacaatttcctactttttaatatatagatattttagatttgaca

SEQ ID NO: 999 - DNA, 366 bp, Homo sapiens
  Genbank Accession No. AA429539
atcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaac

SEQ ID NO: 1000 - DNA, 385 bp, Homo sapiens
  Genbank Accession No. AA429572
gagtggctacaaagactttatcaaattattttaaatgttggcatttaagtattcatgtgtatacagttacatggaaccttcaggtcagtggggcacaaatgtggtatacacacgatgagcctggcagggaagcaaatgagaccaggcttggagctacagggatttaaaaaaattggatgtctttctgagggtctgagaagaatagggcagaagaggaaagggtcactttaggggtctggcttaacccactgcctagatctccaactgaagagctcctttcccatcctcaggggaagagtgcctgttttcaaacggcatccctactacacatataccccccttccctaaaatcttgatgtggcaaacacacccaagaacccacagg

SEQ ID NO: 1001 - DNA, 257 bp, Homo sapiens
  Genbank Accession No. AA429636
tttattttggaaaatgttaaaatttattaataatagttaacatcacatagttaattaaactagttatgtattgtacataatgacaacatcttcactagactgagtgctcaaggatttgagatgattcgctattcatcacaccccgaagattgagatccactgtatttacacaaagcaaagccatgtcagcaagggactgtcaacctgattctgagaacataaacattcaaaatttattttccagtgttcctttttgg

SEQ ID NO: 1002 - DNA, 408 bp, Homo sapiens
  Genbank Accession No. AA429651
tttcaagtaagttcacttttattcatacagtcattagagaaaatgagcaaaatttccagtaaccccaaccactgccttttctccctggacctagtaaattcctatcaactctttagttgactctaagaactgggctctatgagatcctgacagctaaaacacaggtacagaggagcctgcataaacgttttggtccaggtcttggcctccagtcttatgatgggctggtagaatattgcttcatcagatgcttgtgacagggattgcaaactcgctcaagcttgatacttgaaggaagaggcagttcatttgttgaacaggcatcacagaaggttccgctgcagttcttacacacattctttgttaggctgccgtcttcctggcatagctgacacaactgtggctttt

SEQ ID NO: 1003 - DNA, 356 bp, Homo sapiens
  Genbank Accession No. AA429825
cgctaccctatggccgtggcctcaacaagggccacaaagtgaccaagaacgtgagcaagcccaggcacagccgacgccgcgggctctgaccaaacacaccaagttcgtgcgggacatgattcgggacgtgtgtggctttgcccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaa

SEQ ID NO: 1004 - DNA, 281 bp, Homo sapiens
  Genbank Accession No. AA429890
tgttgtgtataaatactatgctttaatgagccccttaaatagaaattccactacaaaaatacagaggagatagggtgtttcctgtatccgcctcattcccatagaaaactataagggaagaaatagaacttggaattaaagcagcagcaaggcgaggtgagaatgcgatttctaggccatcttgttgggactgatgaacagcatctctgatctcatgatttaacatctggttatccagaagggatgggattggcctaaaaaaaccgatcaatttctggatt

SEQ ID NO: 1005 - DNA, 212 bp, Homo sapiens
  Genbank Accession No. AA429904
tttgaagtttatgcattttattagaagaacaagaaataaacatagaagtagcatactaaaatgagctgcataatgtgcacttttaaacataaacaagcactacagcactataacttgaaaaaaaatcaaagcgtctgcagttgagggaatgagctattgcattttggaggaaaattactatgggaagagttggtactcatgaaatattctgg

SEQ ID NO: 1006 - DNA, 481 bp, Homo sapiens
  Genbank Accession No. AA430011
actttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatt

SEQ ID NO: 1007 - DNA, 421 bp, Homo sapiens
  Genbank Accession No. AA430026
tttaagagtaagaaaaatatacaactatatttaaaatacttaaattaacaagatagtacttttccattctaacaaaatatcatacattcagtttaaacaagagttaatatccagacacacgttttcaaaatacctgatgctagttgaaaattagtgaccatgaggctttccaagatatttctaattagcaaactgtgtacaattttgaagaagtgtacacaccgtgctggaagacagacactgaacaggtcaaaatgcaaactcatgtatctttcatcaacctaaatcttgttgcttcacttttctaaatgatactttggctgtcagcgaatcttatagcttcttttcccttaaagacaataatatataacaacaccaccccacacaaataaccataaacttctttgtgtgaaataagccc

SEQ ID NO: 1008 - DNA, 418 bp, Homo sapiens
  Genbank Accession No. AA430028
tttagggcatcacaggttttagaaattaatgtatttttagcattccacagtaatgatcactttcaaaaactgcaatatacatctgcatgttacactgacatacaacacataagtattttgtcacacatcaacttttagcctcaaataatagaatacaaaaagctacactggacataacaccacagaacttttgaatatccccttttcccaattgttaacaggtagtactttttttctaaagagaaagtgatgaaaaatccaaaatttctgcatccagtgtttgactccaactttctactttatcgtctcctggtaccaccatatcctgatgcagttctggttttcgtgtctgagtttgaacataccgaatagctgcccgagcctccatgaaggggtgagtaagccctattccacgtgc

SEQ ID NO: 1009 - DNA, 434 bp, Homo sapiens
  Genbank Accession No. AA430032
tttgttaaagaatgctttattaatacaaatacacacaaactctgaagcactaagaaatttaaatatctatgtcacagcaaacaggtggcaattcaacatccagggtcgacagaatgcttgaaggagactgcaacagattggattcccatggtggagagggcatcttcacaggtgaaggggggcccagctgaaacagcttttcaagctctctctcctcgtcaaggatcatgagaggcactccactcaaggggaggtgcgcaatctggtgctcttcaggcaggtcaaaactctcaaagtctagaggattgaagggaaagaatttttctatttctggataggcatcatctgaggcaggaacagagctttttgctttaacagtcttctcagtcatctttttggcagaaaagcttggctgtttttgtttgaggggtccc

SEQ ID NO: 1010 - DNA, 430 bp, Homo sapiens
  Genbank Accession No. AA430044
ttttaaataatgtcttcaccaaaaaaacagtcttgtaccaataaaatgcattcaaaaatagaaaatattacacaacaaaaatatgtatccttcctttccaaaaaagattcttcacaaaaaaatgtagaaaaaattccaacaatttttttcctctcctaaacattaaccttcagtctagggcacaattatttattgatttaaatgtctgtttttgcataaaacatggaagatgcaaaacatttactgtattaggattgtgaagttacagccactcccacccctgctctaaaacaaaacaaaaccagaaaaaaaccagcaaacattaaacaaatgatagagtcagttggctaggaaaaataccgctgttcttccctttactgtgcatttgtatgggtaaacgggccagtttggtattggggaatgttgacga

SEQ ID NO: 1011 - DNA, 424 bp, Homo sapiens
  Genbank Accession No. AA430047
tttctttcttttctttcttttctttcttcctcttcttcttcttttttgcaaataatttacaggcatatgtaaaatacagtaagaatactgggtcatagtttcatccagtgaaactctgtgacaatccttcactagaaggagagtacttttttcacacagtcaggggatgaggatctgatccgaattacattttgtcgagtcactcattcccacagatttgagtttgaatgcagcttgtggggtacatcatcaggaacattgcacaattattttatgtcatttaaaagaatgatggaaaggaatgttaccggtgcttaaaggcctcagtaggcactcaataattttatagaatagttaaataaatattgcttacacataaaaactcatctcatttcaagatgagggggaaaaaggcatttgggaa

SEQ ID NO: 1012 - DNA, 490 bp, Homo sapiens
  Genbank Accession No. AA430048
ttttttttttaatcaatataaataattatattctgcttcagaatgaaaacatttccagaacattgtgggagcctcgcttgttcatcaacattacctgtttttatcaaatactgtcatttgtgcaacaaatgtcttttccccatcctcacgatttcattttcttctggctggaactcttcactgacatcaatattttcatggtttctccattaatcattccattaaactctcttcttcttggacgagtcactctaaatagcaacgagtaagacttcaccatgtggctgttactaggttcaaattcattactggaaactgcaagggacgggaaatttccaggttttgtttgattgaggtcaggattcaaaggcacctgctttttacctgtgggaacttgccttattggacaacatacatcctttctttttttgtggcaaactttcacaagcaggacttccagggtaacagaattttgttcattttctgagtt

SEQ ID NO: 1013 - DNA, 318 bp, Homo sapiens
  Genbank Accession No. AA430108
tttttttatactgatatgaccataaatatttttattaaatgtgaaaatacacgggcataaaaatagtacccatatttgtagacatgtctgagacccatttcaaatattaggttccttttttattaaaacactacattgagatggattaagttacttagtcttttctcattcaaaacaaactaaaacctcacagcaagagtaatattttcacaaacatctccaatgtttacctcctccttgctcggctttccactgcaggtaagtgtttcagccacagacaagtgcaacaaaaccggttactatacacaaagccacgca

SEQ ID NO: 1014 - DNA, 438 bp, Homo sapiens
  Genbank Accession No. AA430154
tttctttgcaactcacttttattgtttctttataaacttcctctcccatggaggaatatattgttatagtcattagcttatctctttttttaaaactctatgctaacagcaatggagccaagaggaggaaaacataagctacgatagaaaggcacttagaacctgttaaaatactgacgtcctggaatgtgcaacaacacaccaatgacaaccacaaaaagtacaccggccctgccgagcctggtccgtcaccgagtcgcatgctgagctcgtcggccttccagtgccctgttcctccgctctgctcaagtcgcaaacccatgaccccgccaggacttaaggcctggggcctcacaggggtggggggtgctcagggcctgggtggggccgaagaaaggagaccagctccctcctaccttgctcatagccccttcgagg

SEQ ID NO: 1015 - DNA, 436 bp, Homo sapiens
  Genbank Accession No. AA430474
ccaagaataaagtcgtttattattttcagagcggcgggagtagggctggggaccctagggccgctccagtgggacttccctgaacccggttgtagaggatgatggcgcctttggcgtaggggcagagttcagcccacatctccgtctcgggcaatctccgcacgttctgtgtctccacaaagaagattcctgtagactcgtgggcctcgggtcccccactcaggtagtgcttcctcacctgctcagaagtcaggctgcactggacatagaactcggcactggctcggccagcactggtctcatttcgggcgatgcagacagcaggggctggctcagggtgagcagcggcaggttcacctcatcacagatctcctgaaggacactggaaaagagttcatgtaccaccagctgtccagcgaggtcctggtgctggggg

SEQ ID NO: 1016 - DNA, 328 bp, Homo sapiens
  Genbank Accession No. AA430666
tgaaagagaaatgagacttttattagctccaagagcatttttcaatactaaggcaaaaagtaaaaagaaggacaaggaaaaccaaggcacaaagaagggacctaggcgcaccccagaactcaccacggacacacagcagagggcttctcttcatatcaagggtatgggtaaacaagaaaggctgctgtttcactgagacaggacgaaccaccaagtccaaatgagaagacaagcagagacgtagtgtcagaccaggagggttagaacttgctagtgtagagggcaataatccacttgggcacacggaggaaggagggcaggtaggagg

SEQ ID NO: 1017 - DNA, 314 bp, Homo sapiens
  Genbank Accession No. AA430673
taagatgacttgagtttcttgcactcaaagagagagacacagtcagatgtgtctatggtattgcctagaacgtcttaactactgagaaaggatgcgggggtgcacgcacgtggttactgagtggggggtggggaggagggcaccaaggctttctcaagatttacctgatgtgaacgaatcactggcgtgaagttgtggggaaaagaaaaaggcaggatcagaaaacaactgaaaataatttacgcttcttaaaaaatatctctgcttcgggtggttgtacaaaatgatttcctgatgcttgggatctgaatggc

SEQ ID NO: 1018 - DNA, 290 bp, Homo sapiens
  Genbank Accession No. AA430674
aaatacaaatgttttattacgcaaaccacatgtaggtcccaggctcaggggcttaccctacagcccccactggtccctggctccaagcctgctccttgcccttgcccaccctggaaagccaggatctcctatggagtgtgtaggtgtccacgagtgtaccggtgtgcgggcctcctgggctgcaggcactcaggcatggtggcagcattgagggaaagacaggtgttggggagcggggtcccacctgcccaggctcaggagtcacaggggtctgcacagtcctttctgct

SEQ ID NO: 1019 - DNA, 392 bp, Homo sapiens
  Genbank Accession No. AA430675
ttattttttttttttttttttttttttttttttaaatatgaaattttactcgacaacagaaaaggagaaacaggaaaaaaggtgcctcgagcaaagtcaatgacttggtggtggcagagattgtttcctccaaaacgagaatggtagtaactagggcaaatttcacaggcctaccaccaatctcaccagtccaggaattatataggaatggtcacattcctaatgatggtgaagcagaaagccctccccacagagagacagcccactggggacccagctcaagctcttcaaaacgtggcagctacaggtcacaagactttggcagagatgtccgaaattcttcaaggaaggcgtcacgatcagagggacggatccagctcaaatagctttct

SEQ ID NO: 1020 - DNA, 351 bp, Homo sapiens
  Genbank Accession No. AA431337
ttttttgagaagcaagacgaccgtgtgctaatgcactttatttgtagacactgaagtttgaatttcatgtatttttcacgtgtcactaaacattctttttcctttttcaaccatttaaagatgtaaaaaccattcttagcttgtcggtggtgggttgatgcccttggtttatgctgccaacccaagagctacgcctaattcatatccttcagcactaagtcatacagctttattttttttgactaaaaggcccctgaaaatgaaaactttacacatgcaagcagagaggagtccgagactttctgacggggcaggaggggcagaaactgctccctaaggccagggacagcc

SEQ ID NO: 1021 - DNA, 351 bp, Homo sapiens
  Genbank Accession No. AA431429
ttttaagtttctaccaaactattttattattcaattcattttgtaatgatagatcatactctcaaacaaattaaaacacagacagaaaaataaagacttacgtcatttgtgttaacatgccaagccatatcaccataagataccagttgtccattaacataacactgaatttcactgtttctccatcgattgtaaatgtggacaatgctgatcatgtaccacttaaataaaaaaattaaatatatcaatatgtaatgtttggttattatggtctaaaatgcaattataatattcataaaaccctacaataatatgctgacaggactattaatgatcatctaataccacttc

SEQ ID NO: 1022 - DNA, 405 bp, Homo sapiens
  Genbank Accession No. AA431462
tttttttgttttgtcttcctttattacatttttgcttttgagatacaaaccaacctctcataccacacaaagaacatccattcttgggatttttaaagtgcatttccccttgaactctgtgtacaaaaatatttatcttttaaaacatgcaaaaatttcttgacaaggcacttttaggtataaaatgaagatgagtccttggttctacattcacactgaagtaatagtgaaacatcatcacagctgcactctcaaagccctcagaggtccagcagtctctaaaaactcgtcaacaagactaaaaacattcacggctttacaatgtgggttacagagctttacaaccatgaccaggaaaaactgctcgtaacaacagctgtccttcccagttccacatgtgttgtc

SEQ ID NO: 1023 - DNA, 262 bp, Homo sapiens
  Genbank Accession No. AA431480
tttgaggatggacacgaaggaaaattttttttaacaaattaatattttttgctgcctaggcaaatggcttttgtgaaaacacttgtatgaaaagcaatacaccatttgtttttacttaccaatcactaatcattaggttttgatgcaaatgggaatttacaataaaatgaaacaaataggatcagggattatatacaatactgtgatcaagtgatttgtgattcaggcaatgtactacttgaaacacatatctggatttctc

SEQ ID NO: 1024 - DNA, 323 bp, Homo sapiens
  Genbank Accession No. AA431571
tttctttagttttgcttttaatgaaggacaagggattaagacacacagagactggccagacaaatgggaaaccgaccagaccagcccatgaccaaaatatcacaggcagaccacccgcaaatgcagaggcctcagagtccacagtgggcagttggaaccaggccccagggaatctttcagctgcattccggctgtgatcggcgggcaacaggtagaggtgctggagggggatgagtcgtgattttcagtgtctgtcatattcgatcaagtgtgtcatagagcttcctgtttcatctcccagttattcagggagaggctggtgg

SEQ ID NO: 1025 - DNA, 328 bp, Homo sapiens
  Genbank Accession No. AA431719
tttaaactactgttgtatcattgggctgcgacggttacaagtccacaaactgtttaactggacatatgtgaggtggtaaatccctccattttacaggtctttgggaagttctggggccaggaaatccaaatttgataataggattttctcaactgaactcagggcagagcacagatggtctgagtgaacgccctgtgtgacaggtgccttcctgcaggtaggaacacttcctctgcagtcagagggagaagaaaacatcaggagctggatgtgatttcagatctgcaccgagaaacatgctgatttcactggggatgtggcagtccca

SEQ ID NO: 1026 - DNA, 469 bp, Homo sapiens
  Genbank Accession No. AA431773
tttttcttttggtcaaaattaactttatttttcaacttcatagggatgtgataacaaaattggcacacacaaaaagaatactgatattgggcctgatttaaaaaatgcctctggcaggttgtaaaaaagtgaaagtaacaaagataaacatagaagttggagttgtaaaaaagtgagttggaattcatgctgccatgatctacttgaccagaggcagcttttcctctctaagcctattttatatctgtcagtggatttgagatcactcattttaccattgtaacattccgagccttttgtcactgtgtgtccctttgtggccatgtaagagaccacactgctgtaggctgagaaggccacagtggttcaggtgctttgaggacttggtcttggctcaatagagcctcactggtgtttgctcagattgggcagcctatgcccaagctacttggctaaacaggctggtgac

SEQ ID NO: 1027 - DNA, 314 bp, Homo sapiens
  Genbank Accession No. AA431776
ttttgcgggtgtgagcctgcagtgtgtgcgtggcagtttggtttattggtagtgtcgtctcagcagcgtgccacatggccaccatctgcgggctgcctgctgccctcccaattgtccttggccctctccctgcccagggagcctgcagggaccctcggtgccaggctcggctgctgagccagcttgggtgtgaagcctgggctggcagctgaatgatggagagagggtcaagaaggtgagagacccccaccatggagacccagcagagccttctcaaatgctgataagccaaatgtcacaaggtgacaagtcca

SEQ ID NO: 1028 - DNA, 425 bp, Homo sapiens
  Genbank Accession No. AA431873
ttttttcacacaagaaaagtttattgaaaaataaagttctccctagttttctctacaacagtggaaaacaaagcagtgctctctatgccaggacagtacatttggacggcgacaccttgtttgcagaatcctgcattacttaacccccgaagtgaatcacacaaaatggctgtaaccaggatctgtttgaagacacagatgcaaacggccattagcttaaagacgtcaaggttgtgacagcaactacagtggaagggacgtcaccatctcctttggcatcaactattatgctattaatacttgggtaggacaatgagcaaaatgcttcccaagttcgctccctctcagctttggcagatgtgaagctgctctgaggttcctgacacgctgtcctgagaggcgtgtagacctccagcaccacagat

SEQ ID NO: 1029 - DNA, 489 bp, Homo sapiens
  Genbank Accession No. AA432162
tttttacagtttctttttttgcgttttatttttttcaaattgcattttacagtagaaatgcagaccactttggatagctatggctcgatacttctgggtgccctcctcctaagacatcctcttcttacattccactgaacagaaaaccatcccttctactggcatgaacttctgcccaatgaggcatttgctgcagcaagagcacagaaagcactctgtggatgcatgccagctgaaattgttataggtcacccgctgcacttctgggtcgatggcattgtggcatccttgacacaccacagcgtgattcttcacatagcagggcttgcacacgggcttgtcattgaccatcacgtatatctccccagctagaatgctatcacagtcaaagcagcagaagtgtttcaggtgccaattctggttttctgcctgggtatactcattgctgaatatcagctcgtcacagccagcacatcggggtttctcgct

SEQ ID NO: 1030 - DNA, 326 bp, Homo sapiens
  Genbank Accession No. AA432166
tttcaaagataaaatgagtatttaatcagtttcagaaaaaaagggtacattacatcgatgagaaagcataaaattaagaggcttttctggaaatccaagccaaagacctaaccattactatgttcagtgaaaatttcctcgatcggcctcgtgtccaaagctacctattggctcctcaaaagcagctgcgccaagaactagctagccccctttatctcactctagctgggacagactgattcccctccacccccacctctcttctttcaataacactgggtaggtgttaatggcctgggctctcaccaatgaagagaattgtcctt

SEQ ID NO: 1031 - DNA, 376 bp, Homo sapiens
  Genbank Accession No. AA432168
tttttttggacaacagaaataaatcctagaggacaaaattaaactcaatagagtgtagtctagttaaaaactcgaaaaatgagcaagtctggtgggagtggaggaagggctatactataaatccaagtgggcctcctgatcttaacaagccatgctcattatacacatctctgaactggacataccacctttacgcaggaaacagggcttggaacttctaagggaaattaacatgcaccacccacatctaacctacctgccgggtaggtaccatccctgcttctctgaagaagtgaaagagcactgatttcagcagctaagaaatgggctcttttaaggcgatttagacattgcagattgttccacagagaaggta

SEQ ID NO: 1032 - DNA, 291 bp, Homo sapiens
  Genbank Accession No. AA433930
tttttttttttttttttttttttttttttttttggaacctcgggccacacagctcaggcacacaccatcggggctactggctgcttggagtttattttccgcttggtgccaggtgcacagttccaggtgtcaggaaagctagcgagtgctggggccgggcggtagagagcggggctctcactggtttttggtgtctgctgtgttgatgcgaaggtctgcttgctgcagccgcctagtttacagggtggggggtgggaggtggggaggggggcgagggatgcggagtgggga

SEQ ID NO: 1033 - DNA, 488 bp, Homo sapiens
  Genbank Accession No. AA433946
tttttttttttttttttttttttttttttgggcagcagaatcaggtttattggagggattgggggtaggatgagcacggcatggggcttgaggtgtgtggagggagctcagcaggcccagaagcccccttccaccggcaaagtggaacccgtggtcatgccacttcggtcactcagcagaaagaggatggcgttcaccacgtgctctacctcagcaaacttgccaagtgggattcggttcagcatagtcttggccttgtgggggtcactccaggtggcctggcccatggacgtcatcaccactgtggggtttactgcattcactcggatcttgtggggcccgagctctagggccatcaccttggtcagcatgtccagggcacccttggtggagcagtagacgctatggttagttactgcccgctgggagcactggctggagacattcacgatggcccctgggactccccgggctattaagccctggcc

SEQ ID NO: 1034 - DNA, 488 bp, Homo sapiens
  Genbank Accession No. AA433947
ttttttttttctcagaaagaaacatttaataggaacttacaaacagaagcaatgtttctagcagccactaaatggcggcactcaccctcccaaaagtaccctttatataacaagcatttttggcaaaacgtgtagctagtcatatctcagactttcttgtgaaacacctgaacactggggaggttagataagcatctttatgaggggttatctgtactaccggcactgtttaaagacattgctgcagaatatcttggtatgcaggagtcaaacagcagtcatcatgccagctgctcttcaagatgacatcactcttacaatgcaacaggctgttttcctacactcgacccctcgaaaccagtccttaaaatcttacatgcctgcttcttctgtgatagtccctggacctagagggagggtgcttgatattgtatggctttagtagtattgcaatggaaatggaaaacagattgggtccagtggaattc

SEQ ID NO: 1035 - DNA, 265 bp, Homo sapiens
  Genbank Accession No. AA434225
caaaacagccttatttaatcaggccccagaggcaagtctggggtatacaggcaggtgggattcctccccgggaggtcatacctgacctttctggggtaagagggaggctggggcggggatgttggggaagcggcctgggagacggctgtcagggttgcagcagggacgctctgggatgagctgggggcaggcggtccctttgggaggtgagacaatggccctgtgtggtacactccctgccccccaccccccacgggccgcttgg

SEQ ID NO: 1036 - DNA, 217 bp, Homo sapiens
  Genbank Accession No. AA434418
tcgtaaactgccttcctttatttatatttgcaatatgaaatagaagctcggcacaaacgcacgcacactcacaccagcctgggaggagggagctggggacaaggtcacttggcaacagggctgggacctcagaccctcaaggcccctggggctgttgccggggaggccctgctccccagagccggactggcctggttgaaagtgcagggtctgggca

SEQ ID NO: 1037 - DNA, 399 bp, Homo sapiens
  Genbank Accession No. AA435526
ttttttttttttcctgtttgtctgatttttattatttaaaaaaatggaaaaacaaaagtgcatttttcattcaataaatgttccatccttatttagttttgttgccgaaagtgaagtccatgactttagaatgatagcaatttatcaaccaaagaatccgtcttcacaccgtttcaataactgcagcaatttccttgaactgtctgtagaaattctgaaactgtggaatcgtcatttcaaagcacttggtctttacttggcctgaatgatctgccacttttagcatcactgcaacgtaaggatacttaagagatctgcaagtgtctgagctcacagccatacccagtttccactgaaaatctacaagctggttggtgacatcggacttagcatccagcg

SEQ ID NO: 1038 - DNA, 320 bp, Homo sapiens
  Genbank Accession No. AA435591
ttttctgagttaaaagttttattcattcaacatctcacattacaaatatttaaaaattatatgcatactggtataaatagtcatttgcaaactatttaataacattaatttttcactagcacttcaacaaatgaactcttttaaaaaaggaactgtgttatataacttaagagtagaacatacaaaaataggaacttaacgtgaaaatgactttaataaaaaatgaattacccttatttaaaatgctataataaatactacaacctccccatacacagtaaaaactatatggaaattcagccaagtagtacaattaactg

SEQ ID NO: 1039 - DNA, 373 bp, Homo sapiens
  Genbank Accession No. AA435662
ttttatctcagaggtaaaactccttaatctcagagcgcccctcccaactgccgatcccccaacccctcactctctcccccacaccagggccggagagtgagggcccctgccccccaccttgggtggacgagggccctttaaggcacctgtggaggtggggggcgaggggcgggactgtgtaccatcctggatgcagggacgggcttcgattggcaggctgttgtggggatggatggaaccaatgaaagggggtgccataggcagggacagtttggggccatccctgagggggtcagggaacaagttgtcgggacgtgggcaaagacgaccccagtccccgtagtgtaaagaacgtaaattgaaggccccgggc

SEQ ID NO: 1040 - DNA, 277 bp, Homo sapiens
  Genbank Accession No. AA435665
ttttaaagtgcttctttttaatgaaacaaatccaagagatgtacagtcaggctcaagttgtgcagttcacaagcatggaggaaacagacagaacgacagcgttcaggacagtcagagctaacccaagacgaggctggacttgccgccaaggggatttcttctggatggcactggggccggggcaccgggctgggcacaggcgcacaggcacgggcttctcttcactctgccccaggctgcctggcaagtctgtgtccacattttcatgaatatcacc

SEQ ID NO: 1041 - DNA, 378 bp, Homo sapiens
  Genbank Accession No. AA435681
tttttattttttttttttgtttatgtaattcagcctttactgtaaaaaaggaaacaacaaaaacaaaaccctattaataaacacaatgcaaacaatgcccgagattatcataaaaacatactagcaagccacaagtaccagagaggggtgaacaggcatatctgctagctctcctcttgcagtcctcagcctcccacaggaggcacaaggtccaaactattcctcaaaaaaaaggacagcctctttatgctgaaataggaactttaaaggaagctcttcttgtagtccaaatggacgtaccttgtggtatggctgtaaggactcgattttacggcttgtgtattcctaactatagctaggcctgtcacctgctgttcc

SEQ ID NO: 1042 - DNA, 391 bp, Homo sapiens
  Genbank Accession No. AA435738
tttttattttttttttttttttttttttttagaaggctgaaccagacgacctttaataacttttatcagttgagactgtgagattcaatgactccatgacacttgcagattcagcttcagatttcagccactttacgggaaaaagagacacatcgaaaacttgatcctgggacttgcaaccccaccgtggcacttctccaagaaatggatggttttcaccttcctccccttttcctgcctcttgccagggttctccactgagtgaactcaaccagaagccaaaggacatggaaacccattgatgtccctcccaggacaaggtggatgaacagaaattgatcttgaggaatgtcctggaggaatcgcttggcaatcttcagacgagaaatgc

SEQ ID NO: 1043 - DNA, 383 bp, Homo sapiens
  Genbank Accession No. AA435746
ttttaattttagggactaggttttgctatgttgcccaggctggccttaaactcctggcctcaaggtgatccttctgtcttggcctcccgagtagctgggactagaggtgtgcaccgtcacacccagcttcaagtctcttattataaagttctggccacgcacagtgcgtcgcaactgtaatctcagcactttcggaggccaaggcggtcagatcacctgaggtcaggagtttgagaccagtctggccaacatggagaaactccgtctccactaaaaatacaagaattagctgggcatggtggcacacgcctttagtcccagctactcgggaggctgaggcaagagaattgcccgaacccgggaggcagaggttgcagtgaacc

SEQ ID NO: 1044 - DNA, 451 bp, Homo sapiens
  Genbank Accession No. AA435748
tttttcgttaaaggtatttttattgctagtacaagattgcaggatctaggcaaataatataacaattaaatgtgcaaatctcatgaaggtaaactacctttctgttctgtaatatttacccaaatagtcaaggctcagacttgttaaactgtggagttactaaagaaggggggattttccaaattgtagaaacaagagtagtcagattttcccatccctactagctttctaggttaaattcaatgatgtgaaaacaagcatagggtagagtccatatgatattcatacaggaagaatgtccactggggaagctctttcggccctcattcaccacgtccttatcccctgtacacatcaagtcagaatgggctagccatcagggaagcagcggtagaagaaatctgggcgtggctccctacgatcagttttattgtgttggtaaagacgccat

SEQ ID NO: 1045 - DNA, 225 bp, Homo sapiens
  Genbank Accession No. AA435753
tttttattttttatcttttttattgcatttttactgccgctttttttgtttaaatatgtttttatacacaaacgccattgtgtttgaattgcctacagtattcggtacagtaacatgttgtaaacatttatagtggctatggtttggatatttgtcccctccaagcctcaggttgaaatttgatctccagtgttggaggtgaagcctaacgagaggccttcgggc

SEQ ID NO: 1046 - DNA, 265 bp, Homo sapiens
  Genbank Accession No. AA435769
ttttttgagctttggacaaatttattgaaacatacaggcggctgttagcagagaaatcattccatgattgatgtgttacatttggccactaccttgaatgtataatttaaaaattatatttttcacaactaagcctttggccaaaaaagtcatttagcacatctttaaagatcaataagaaatggattttggacattaaaaagatcaagtcactgaattaaacagtagcaacccccattaatctagaatcccatagtgctgaagg

SEQ ID NO: 1047 - DNA, 329 bp, Homo sapiens
  Genbank Accession No. AA435777
tttttttttgcaacaggatccggtttattctgccttgggggtgggtcctgagagtggtgggtgccacctgttccggggcggaaagagggcccgaggaggttaaggcaatgggggagaagcagggggctgagcggcacatgcggtgaaccaggccgaggccggaggagctgtggtaggccagggagggtggaaggcaccggactgggaccggccagggctacagggcgaggaccaggcacacgggcaccccggaggcgggcacagggtcacgtgacacagaacatgaaacacaggcacagggtcataggccagatgcacatccagccatg

SEQ ID NO: 1048 - DNA, 396 bp, Homo sapiens
  Genbank Accession No. AA435824
caaggataatttttattgatgaaaaaaatcttgcagatatgaaaagataatttttttattcctatgacattttctgtttttacgattttcttttcagcaatgaaaacctctgatgttctcttttgggaaggtagtttatccaacataaggatcccatccttttccataaatgaatcgattaatcatgtcaaaagctctcagaggctggtcatagggtaaaatatgtcctccacctcgaataattacctgatggaagtcacccgcttgccggatgtaaccagccacttcactgtcagatttaaagatcttccaaacttttttttctgccttcttgtattcctgggatcctttccagtccatgcccatcaaggagcgctctgtcagggcagctgcacg

SEQ ID NO: 1049 - DNA, 294 bp, Homo sapiens
  Genbank Accession No. AA435985
tttataaagatttaatttatttaaatcacataagattattcaaagccataggcatgattaagtctctatagaatcaagaagattttctgtgtggagaatatctcgtggagatttgaaatgtgtcgcctctcctgagcagccaggattaactctgcttaggacgtttcagataagggtcaggctggcgtccttctttctgcctccatgggttgccaccttttgctatgtcaggggggtcgcttgcttaagacgttgcaaggagcaccccaaatgccaggcttcccaccatagctg

SEQ ID NO: 1050 - DNA, 309 bp, Homo sapiens
  Genbank Accession No. AA436027
tttcaaaatgtggatattgtttacttgaagcaacagtccaggattgtgaagtacaacacattttaaggatgagactttcctttcatggtcaagcaccagcatcatgcacacagcatcaggttatttaaaacaacacgcctgtgggaccccgttcctggaggaagacccgcttcagtgtgattgcctcccttgcttcactgcttttagttccaggcagtttcattgtacatccaagccttcctctgcgtgagagcaaaggctttgctcatcagccagccagtcttgttactatctggctactttttaagg

SEQ ID NO: 1051 - DNA, 373 bp, Homo sapiens
  Genbank Accession No. AA436156
ttatagagtttcaacaactttattggccaaatgcttctcctatgtttacaacttagtgtgagcctgctcactggcttctccttctaagcccctaagcaggcagcaaactttagtacaggcctggagatggggtagggggtaatgagtgagttggaaacctgctgatgctccacaattggacagcaggacagcaaatcttctacttcttattgccgaaaactgcagaaagacacgaacaggatggagacaggaccgagagtgcatctctgccactggtcccagtttccagtttctggtgcatccaacagagtataccctttgtattcttgcttcagggattgggtgatactatgtcagcctacgcattttgcag

SEQ ID NO: 1052 - DNA, 324 bp, Homo sapiens
  Genbank Accession No. AA436473
tttttttttttttttttcattctaagagcagtttttatttagaaatgtgcttccacaacttggtggccacctgggggcaggtagcccggcttgcttgttctctctttcctagcccaggaatcgggtccttgggtctaaagcacagggccaagttctcaaggatcaacatcccagacagctcccatggtctggggcttggagctggtatgaagggtgaaccaggttccatcctggactgtttatggttggagggcctgggccctggcaccaggacctcagctccctctcctagtaagtgctgggatcacccacaggccagctgtg

SEQ ID NO: 1053 - DNA, 377 bp, Homo sapiens
  Genbank Accession No. AA436489
cgaaaaatatttttaaataaatttttttttcttacattctgatatacatatgtaacaaggtttatggcactgtaaccagaatcaaatcagaaaaaaaaaaaaaaaaggaaaaaggtgggaaggaaagtatttgatatattgttgaattcctttctatctccaagctggcaaatttgcactatttgtctatcattcagctgccagctctaacttgtttgcacacttaaaacatcatattattgcacaagaagccagtgaaggcatataatggtcagttcctcactatttcaaaaaaaatctcttaaacccagagaaggaaaaaaaaaaaaatccagagcatgaaacacacaaaatcaaaggtatcctttttctcctta

SEQ ID NO: 1054 - DNA, 334 bp, Homo sapiens
  Genbank Accession No. AA436548
gagaagccatttattttgcagtcttcagtccaaaaaaagtcaacattttcagaatttttttatataagttgtaggtcatttttataacaataaactttctattatctatttatctctcacatacatttcatgtatcctgagtattatgttacaacaatctgctcttgatagtaatgttcctgatagattaaaagattgagaaatacttgaagaacgatcaaagatacaatgagcatggtatacttttgggttaaaatgtattctttgataactgatgtcatatagatccctaagtaaatcaaatatttaatttcctacatctgtctaccttagt

SEQ ID NO: 1055 - DNA, 405 bp, Homo sapiens
  Genbank Accession No. AA436560
ttaaattaaaaaacaatttattgaaaaagagtaatgctttatacaaattcccattataaaaccccaaaatgtctattggtctgtttccaggtgtggtagaagaatataaaaagatcaaaattggataaattctattgtaacaatttcgttggtcattttgggccataaaatttttttgtaatgtttggtaactgatatccacatggaattacactcacacatcatgaagatctatgtatgtggcaaaagccatttaaattttaacttccaaaagcatatattctcaggtttggaaggcacactaaaatttattaggtccaattcctcataagacacggtggctgactttccttgtgtagtttattatgaagtaccatttccaaactaactatcctagcagcgtca

SEQ ID NO: 1056 - DNA, 437 bp, Homo sapiens
  Genbank Accession No. AA436616
ttttttttttttttttttttttttttgtaatttaaactttatttcatatctattgttaaattacacaaaatcagtgaatggtttgtaaagctacaccaatggacagatgtttacagttgaaatcatgggatttacataatggcaaaaatgtatatgtatatttataacatcctctatatacaataatcagtatagacagagaaaatgcacttaatctttgcaaatcatgcacaccacagcaataacacaaaatgttttttctgtaacaagcttttccactggctcaggcttcatcctgctttccaacaatacctatcagttttaaaagcaaacattttcaattaaaactaaagaaaattgaaataccatagtgatctactaactattttaaaaacacaattgtacacaaaatagttttactctaaaacactgtgact

SEQ ID NO: 1057 - DNA, 441 bp, Homo sapiens
  Genbank Accession No. AA436690
ttttttttttttttttttgtgctttaaatatatttttatttgtttttctttatattaatttttttctcccatagaggaatagcattacagtctaacaatcagaattctgttacacacatacacaggcatgccacatgacccagttgaggtggttgtctccttgagtctgttgacacgtcacatggtcaaagtctcctcatttcagccagtctcaacacaaaacacccaacagggatgcactcaacttgttggttccatgtggaactaggtggcagggcgagagggaaagtagtagaagggggctatggtgtgtctgcattcagtcccctcacataaagccacatggatctaggggggtatccaagagctctggtggggtccgtgttgcacctaagacattataggtcagagcaagttgctcagagggttccaggcaggggg

SEQ ID NO: 1058 - DNA, 407 bp, Homo sapiens
  Genbank Accession No. AA436880
tttgcttacatgggcatccttcagcttttaataatctgaaaagctctatttacccattgtcaatgtgtataaattaatctgagtcaattttatacaataaaaggtgaacttttatgcatgaaacaataatttaacaaaaaatgtaccggaagaagaatgttcattacaaatataggaaacataaatattaccaaatattggcaagcactaaaatgttcagaaatataagtctactacagttatagctctctcaagcaaaaaaatagcagagaaaaacttagtttaccttaggggctatttattttcttagggatttgttaaaaggtcaaatggggtcacacagaatactaagaagagctgttcacccaggcctcactaagaactcttcttcattcagtagctatata

SEQ ID NO: 1059 - DNA, 491 bp, Homo sapiens
  Genbank Accession No. AA436926
cctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaagggaagatactatcacataagttttcctcatctgttgtgatatacaccaatggataaactaacggaaactgctttttgacattaaaagacaggagaaattatatttaactaagtaaaagt

SEQ ID NO: 1060 - DNA, 227 bp, Homo sapiens
  Genbank Accession No. AA437235
tttagcattagcaattttttatttttccttttttgttgcataggaaatgcagtacttgcttccagtaattgtattgtaatgtgagaaggtggtagcactaatggttgaatacaagagttaaactaatccacaccagctcaaaaaacctgtggagatttagttgaataagaatggacgcccacagtgattctcaaccaattacaaattttcacagaacacagtaaaac

SEQ ID NO: 1061 - DNA, 409 bp, Homo sapiens
  Genbank Accession No. AA437265
tttgactttttattttattatttatttcttttaatacaaagctttggcattagcaattttatgaaaaaataaaatgtactaaaaataaatgcttgtgtggcatgattggtaaatgatgcacaaaaataggttcttttttccttcaaggcaaaatcagtcagaaagcaggttttttcttcttcaaaaccattctacctcattagcattcaagctagctgtggctctgatgatcatgtagcagagtgtgagggcactgaggaggccaaaactggcaataataaaccattcttttgttactgcaatgttgatttctcctgttctcggagtgagctccccatcctgaggaagaggtgagatccccgaagttcgaagtggctcaaggccaagggagttgtcgccggcgaggtcg

SEQ ID NO: 1062 - DNA, 398 bp, Homo sapiens
  Genbank Accession No. AA437295
tttctttctctatatagttttatatttagtgtcccaccatagaaaacttcatcctcaatatagcaagtacatgaggtggaggggagtctggcccaggaagacacttgcgaatggaggagcagagagagggactattgacgtaaacctgccacgtgacacgactcggctttgtggaaaccatacgtgatttcgaagggattgaaaatggagatttcaagagttctcctcgctcccctggggcatgtgtgcccctcctcccgccctgtcctcagctcgcacgcatccgttcagttgcttctaccactccccagtcggttgtcgctgggtgtcactcagttgcggacgcggcagaagtgaaagctggaaggaagaggggcgctccggcctggggaaggggg

SEQ ID NO: 1063 - DNA, 400 bp, Homo sapiens
  Genbank Accession No. AA437368
ttttattatctcaaaatgtgtatttaatggccattccatcaaaataaagcagaatcccatttcaaaactattatatgtatatatatttttaaggtgcattttcaagttttatttgggtttcatttcttcttggcttgcctgaggtgttcttgcaggtacaattaacacaaaatgttctgagggtagtagcttttcatgcactgaagaatgagatcctaacaacattgcacatcttggatacattagaaattttaaaagccatgtgtaatttcagaaaacttaataccgtcatgaaagacattttcaacacaaaatttaggcactctatactttggaatagccataaaatattccaacaagagttaatgcactttgtgattacatctactcaaagataatt

SEQ ID NO: 1064 - DNA, 229 bp, Homo sapiens
  Genbank Accession No. AA437387
tttttttttgaaacaagtaaatcattggctttattctgggtcctggaagctccactgtgagtctgaaaaaaagacacaacaggggcggcactcgggggctggtgcagaaaatagtccctggctcctctggccctgggagcctaaagggcagtgaggagaaggcttagcaagaggcctggagcaggggaagtcaggtccctcaggaacccctcctcccccagaggaagga

SEQ ID NO: 1065 - DNA, 408 bp, Homo sapiens
  Genbank Accession No. AA441791
ttttttttttttttcacagtatttacatttattattattaaatcttcagtacctgaaagtataaatatgggtcaatggaagaaaataggaactgaaactattacaggtgcagatgaagaggctcacttttttctggtctttaatctctctgaagggaatatcggggacggtagttctgatatgaaacggagatggggatatatttctttcctgggagaaattcctatggaggggagacaattatcagagtcttaatggacacaggaaggaatgcttataaggcattgagatttgagattctcatatcaagtgacatccctgttgggaaacggcatggacaaggcagatggggtctttactgatggattgggaagggactagtatgaactgaaacaaacaaaaagaatt

SEQ ID NO: 1066 - DNA, 321 bp, Homo sapiens
  Genbank Accession No. AA441911
caagctggcttttcgtatattgtgtataaaaagatcagattcaggatgatttggtgggattgccaggggctgaccggagtgttgctgggaaggagcctcagctcgtctccaggtcctccaccaggtaggactgggactcccttagggcctggaggagcaagtccttgcaggtccagttccaggctggtgtgaaactgaagagcttccgcatcttgcttgggttggtgggctcggccgcaactgcctggtactgctcatccgtcagtactttcccgtacagagcatccagcagccactcaacgtttgtgaccctcgcgataa

SEQ ID NO: 1067 - DNA, 262 bp, Homo sapiens
  Genbank Accession No. AA442054
agcagttaggtgctgaatgaagctgccatccttgctgcagcttctaactggtaaaaagatccagggatggagatgggaaggttagaaaggcagccctcacctctgaggacagaggccggggtcaggcccgtggcggcaaaggtgcctcatagcatagccagcattcagcacacacaaacctactgcccacatttgggtcagggttggccatttgctagttctgctgccctcttaagatctgactgccaaataaatcatcctc

SEQ ID NO: 1068 - DNA, 442 bp, Homo sapiens
  Genbank Accession No. AA442155
tttttttttttttttttttttttttttttttaaattgaaaggaaacttttattgagtcatgttttcaaagcaatctagtttttaaaaaagttgaagacaagacagaaaaaagaacatgacacctaagagaatcagacaggacagacagacgggagcaggggggcggggacagcggctccgtggaggtcagatcttctccatcttggagatgaggtcgtcgcagatcctggtcagctcctcgttctctttagtcttctgctccactgtcttctccagcgactggatgcgcatctgctccttcctcaggctggcctggagggcaacgcttccgcctgggccttgctccggacctgggcgatctcctcgtttgccagctgcagcttctcctccgcgtgggccttcagggcttggtacctctggccctcctgggtgatccttgcca

SEQ ID NO: 1069 - DNA, 477 bp, Homo sapiens
  Genbank Accession No. AA442334
gacccctggctcttgtccttaccaggcagcccagagccagcctggctgccagagctcccaacatctgcttccagttagggcggctaattctcttttcctccatgttaagcttttcctataaaaagactcctactgacagggctaagtttagccttaactacaaatgccttgaaggttccacctcagtgcagaatcagagaggaaataaaactgccagggaccagagcaggcttcctgccctgtcctcccatcagtcagggtcatgctggtgttaccctgaggctatagccctcccagctttattaattaattctcttaccctgaggctgagggcgaacagtaggtagcatgggagtgtaaaggaatttatctagataagtttgtttacttatgccctccggaaatcatgcaagactgctccctgcaaaggcgggcgacaatgttcattactcacaaattgtgttggcttcaggcctt

SEQ ID NO: 1070 - DNA, 446 bp, Homo sapiens
  Genbank Accession No. AA442342
gggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcata

SEQ ID NO: 1071 - DNA, 510 bp, Homo sapiens
  Genbank Accession No. AA442400
ctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaatggatcttttctagattctttaaacttaaccaaatgttccttttgttcagttat

SEQ ID NO: 1072 - DNA, 284 bp, Homo sapiens
  Genbank Accession No. AA442763
ttttttaccttaagaaaaaccaatcgctttatttttcctcaatatatgtttagaaaactggtctgagaagaggtttcatgagatagaccagaggactatgtacaaaatcaagagttctaaaccaataagaaaaagggcacaatgaagcacacatccccaggggccacggcagcctaggaccttcctatcagtggggaggcaaggtctttgacggcttttgagttcagctgagggatcatgctgatcttcaggagtttgctgcttgcatacttattcttgatggc

SEQ ID NO: 1073 - DNA, 301 bp, Homo sapiens
  Genbank Accession No. AA443271
ttttttttttctttaaactgttaaactttattataaattaaaatttctttacaaaaaaattgcgcataatatttgaccactcttaggttctgatgcactggcatttgcaatagtttctttaatcttcaagttaaacagtctcggcaaggagtccagaacgtagaaagggtaataaacaaccctgatagagcattcaagtgcaactagcagacttgtggccatggcagttacactttccttaagatggactgctatagttttaaatcctgaaatgaagaatctcgaaaaaatttaaaaagga

SEQ ID NO: 1074 - DNA, 393 bp, Homo sapiens
  Genbank Accession No. AA443272
tttttccagtttgtccaagaacctttattggaaaaatgtccaacaagtgatatcactagcagctgaaggggctgccaggtgagagggggagcacctgaggctccatggaagacattggagtagtgcagtgcagcatctgcctctagggtcagacaattccttttatttgctggggtaagaggagtacccacagaaacacccctctctgagggccagagcgaagatgaggggcagctggggatgctcagagtcctgatacaggtgaaatggggcccccatttgggacctaatggagtagggtacaactagtgactctcccctggaccggggaatggaaggagatatcccatctgatatccactccccaggtccaggggcacagactctgaacag

SEQ ID NO: 1075 - DNA, 487 bp, Homo sapiens
  Genbank Accession No. AA443316
ttttcaagaccatccaataatttactgtgatcccatctgtgcccgacaagcggccacagaggcctgggaggggagctaagggctggggttccggtggcatttgggatgttcaagacagtctgtgcacagcctccctgggagggtctgcagtcacctcggcccacggtcccggggtgactgggctccagcagcccttccttccttccttgcttccgtccttccttcctcctccttccgtctgcacctccttcctgcatccggcacctccatgtcctgagcttgtgctgcgtcaggagagcacacacttgcagctcatgcagccggggccactctcatcaggagggttcagcttccgcagcttgtgctgccggatctcacgcaccaacgtgtagaaggcatcctccactccctgccgggtcttggccgaggtctcgatgtaggggatgccgtagcttcgggcgaggtcctgagcctgccgagattccac

SEQ ID NO: 1076 - DNA, 391 bp, Homo sapiens
  Genbank Accession No. AA443321
atttttgctaagtaaaaagtaggtttaagggaagaatcatttatagtaacactgaattaagtaagggtttgtaggtcacagaatcagactatttagggctgatacttcaagcatatctcaattaacaaaaaagcacattgagactccaaggatgaactgcctttgcttagtggccagggcactgtcaagacccagaggtctcctaattcccacgctagcacaccataccacccctttgttcaacctcacagaattgccaatactagcgtatcaccaggaatacttacgaaccatactaactcacatggaagaatggcaaatgaaaactggcccacattttcttgttccttcttcaaagagtaatagggttctacctaattgtgaactagaa

SEQ ID NO: 1077 - DNA, 383 bp, Homo sapiens
  Genbank Accession No. AA443585
agagtaaaaaaggagtttatatatttataaatgccaaataaataccagaggccacccaacgccccctcccagacagggctgtctcccccagccctaggcttctagggtgtgagacatcttggccccaagctatagcccaagagcagctgtcagtctgtgctaccagggaactgagtgaggatgatctgtccagccaagtttcactccccctgtgtgaggggcccccatagccacaggcctgggtccctgtataggaccctaagggtgaaagactcagggggagaaggtggccatctcgagtgagacccgctgccacagctccttggtctgtttgctgcgcttgaggttctgtaggatgtcgttgaactgcatcatgcccatgg

SEQ ID NO: 1078 - DNA, 187 bp, Homo sapiens
  Genbank Accession No. AA443602
tccaagagaacaccaactgtttattacaggaattcctatgaaacagctccaagaaaaaacccacacataggaggaagaaaaataacaaagcaacactcaacagacatggggctggggcgtcccccacagtgcgccgggtcctggccgggggaaggctcagagacccgtcgagaactcgagctggggt

SEQ ID NO: 1079 - DNA, 458 bp, Homo sapiens
  Genbank Accession No. AA443658
ttttggtcactggtttcattttttttcttgctctaaaccacctcttctctgaggttgttcatcctcagggctgggtggggtgcaagcccttgagtcccaagtgtgtcgaggctcctggtcctgggtgtgctggtggatgagtgggcacatgccccacctggggtggtggagccgcttcagtagatgtagggcatgatgcggtaaggcacacgccggcagtactcctgccaggccaggccgtacttctgcaggcactgccgctcatcccgggcctcacggtgcaccagcagcgcggtgaagtagaggaggtagaagtagggcagcaggtgtgacaccccgcagggcaaggaccaagccagagccatgatgaggtctccaagatagttgggatggcggaccataccccaccacccagacaccagcagtttccgccctgtggctgtagagatggtctcaag

SEQ ID NO: 1080 - DNA, 498 bp, Homo sapiens
  Genbank Accession No. AA443756
tttttggatttttaaggtaagcaattattttatttccttggcctgatggcattgacttcattatacaagaacttgcagctgacagaactgacacacacatttcccccaagagaaagaacccttttcattagcagagatgaattgaaatgtcatgtctgagtgcaattcctgctccccactcccaccccacaaaatcccaaaagtgaaaataaatcaataaaatccccatgatttactaaaagtcatccctccaaacctttctaactagcagctgcagtggatgataaccaaggagggaagcagctggccatcatgtagcattcctgtgcatgtgagcctgaagggacagcagcatgggagcaagaatcctgaatgagagtagtatataattaccttacttcatacttgccccctccctacataagacacctctgtcctgatacatggaaaatactagaggagatgctaagagtggttttagtctacaattggaaatgc

SEQ ID NO: 1081 - DNA, 447 bp, Homo sapiens
  Genbank Accession No. AA443802
ttttgctttcaatttttgtttatttttagaaaataaatggcaaaatatatacactgtggagtctgaatctcctcatcatagagtgtgaacgatggtccggctgcgaacgtgctgaatatactctttggcatgggcaactgccgtctttggtggctcaggtggaggtgggggcccttccaccaacttcacaaaataatggcaataaaccttctccatgatcccaaagcgacctctgccatggtagcggatggatttcaggcactggcctcgtcctgaggtggactcagctatatataaattggacctgaattccacgttatggtctctcactgccatatcttgtgcttctaagagaacctctttaattattttggccccttttttgtcattgaattccaactgagccaaagcctggtcaatagacattcctcgtatcaattttgccaa

SEQ ID NO: 1082 - DNA, 481 bp, Homo sapiens
  Genbank Accession No. AA443822
tttgtattgatttcatgatttatttagatatctccccaccccttccaatacttgaaaaaaaaaaaaaagaatggcagtaccagaaggcattggttaagtgtcccaggaaccacacaagcagtgactcctaaagaagttcagaggaaggagagaacccatggggagggggtgcagtgggggtgggtcagggtgggctccctggaggggagacatggtctaggcaaggatgcagactggccagtaaggtgggtccatgcaggaagctgagggaggtggaaggcccgtgggtctcgagcgcatctgcccgccctagtcggggaagagcaggaagccggagaagacgctgtcagagccctggatgcccaccatgtcgtagtagtcattgacagccagccacacctcctggcccaccttcaacctcagacggaacaccgacccagttgacccgagtggttttggacgtgtggccacaggaggtgac

SEQ ID NO: 1083 - DNA, 165 bp, Homo sapiens
  Genbank Accession No. AA443934
tttccatggaggtgggctttattaggtgactgttgaggcaagggaggttctagggctggtggactgatggggggcaagggcttctccttgcttttgaatttagtgcatgttgcctagaggttagatgtgtgagaatagctgcagaagtgagaggagaggaaaaga

SEQ ID NO: 1084 - DNA, 245 bp, Homo sapiens
  Genbank Accession No. AA443936
tttttttttttctggtccgggttagctttattggagcctcctagcaggccaggtgtttcaggcaccagtagtgctgcaggcacgggggcctgtggtgtggccagctgcaggtgatctcggtggtggactccgaagtgtactccagagaggtcccggaatggcaggggaccagctcgggcactgaggcgctgctggcaggctgtttcgacgattccttctggcgctgtccgctggtcttgggggct

SEQ ID NO: 1085 - DNA, 453 bp, Homo sapiens
  Genbank Accession No. AA443941
tttttttttcagcgtggatttattttatttcattttttactctcaagagaaagaagagttactactgcaggaacagacatttttttaaaaagcgaaactcctgacacccttaaaacagaaaacattgttattcacataataatgtggggctctgtctctgccgacaggggctgggttcgggcattagctgtgccgtcgacaatagccccattcaccccattcataaatgctgctgctacaggaagggaacagcggctctcccagagagggatccacctggaacacgagtcacctccaaagagctgcgactgtttgagaatctgccaagaggaaaaccactcaatgggacctggataacccaggcccgggagtcatagcaggatgtggtacttcagggccctgggcaccctgttgatcacgagcctcccgtcatagctcagggaggcaaacagc

SEQ ID NO: 1086 - DNA, 299 bp, Homo sapiens
  Genbank Accession No. AA443993
tgcggccgcggtcagagaaggagagacaccagcagaggacgcgaacgtggaccggccaggttcagagcccgcctcggttgctcccaatcagaatctgctttgtgctccacggcctccaagcactttcatgagcgttctgctcctacgtggccaggtcctaccttccctgacggctctggccaggccagctcggtttccctctaacccatgaggcctgggggggctgtgacagaggctggaaccgcggccagagcccaggggcaggcccgcctggtcacagcaggatgaggctggggtgg

SEQ ID NO: 1087 - DNA, 351 bp, Homo sapiens
  Genbank Accession No. AA446242
aaagatacataaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttt

SEQ ID NO: 1088 - DNA, 527 bp, Homo sapiens
  Genbank Accession No. AA446342
tttgagatggagtcttgctctgttacccgggctgcactgcgtggcgtggtctcggctcgctgcggcctctgcctccccagttcgggcaattctcgtgcctcagcctcccgggtggctgggaccgcagttcacgagaaatccatgaccgtaaagtactgtgatagtgatgtctaccactgtgagcttccagtactaggtgattggtctgcattcacagtgaccaaaatcagctatgtggccaggtaattcactgctgagggctttggattttcctttatgaactactgaaatgaggtcaacttgactattactaagggacattttgctacaaagaatgttagttttgccaattccctttccaaatctaaaatttattttaaccaggattttagatgtaaacatcaagtagttttggttgtttcaatgaagtaacatgtttaagctcacattatttgaagtacttcagttcctattgccatgaaaattgtatccagcagctaaaaaaaaaaaaaaaaaaacctcgtgcc

SEQ ID NO: 1089 - DNA, 404 bp, Homo sapiens
  Genbank Accession No. AA446570
tttttttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaagggtttttttttcttgacttttctataggggtcatattcattaaaaagcccaaaaggctacctttgccttaacccttctgtagtacaggaatgattctagatttgtttccttttgttatagaagcaaatattgtttttttaaaatagcctgagatgagaggttatattgtaccccaccagctaacacactaagtggatgacaaactattctctcggtaatttatatag

SEQ ID NO: 1090 - DNA, 394 bp, Homo sapiens
  Genbank Accession No. AA446581
tctcttttcatttttaattttattttttaaaaaagacattgaggttatggtaagaaattatgaagttacatttttttaatctgtcaattgctacagtagtggaataaataaataagttttttaaagttcaatgtttatagacatacttataaaaaaatgactgaattagaagacattaaataatgttgatacacaccaggaagggatttaggcaaggaaaggcacatcatattaccacaagaaataaagaccatagttggaggttaatggacagccagaactttagatcttgtggtaggtttcccagctctggagggtcattatggtgaaacgttctttatagtactgggctggaataaataaatagcagttgaggaattttaccttgtaactg

SEQ ID NO: 1091 - DNA, 328 bp, Homo sapiens
  Genbank Accession No. AA446587
tttttttcacaccgctaagggctttatttcacagatcatggtggtgagtttggatttccagccctcaccacggttaagtcacacatttcccgacacctgctcatttctccagatctgaaacatctcacccaacacatcctagttgttgtaaaccccaaatgaactttccagaagcaaaaacaataacagattcagagaaccctggtcacacctgctgagcagtcccctctactctggttgcatatagaatgcttgtttgctcaaaagagaggcgctctcaacatcaaggcacaaagaaagacgtctccaggggcaaaatgatgacgaa

SEQ ID NO: 1092 - DNA, 340 bp, Homo sapiens
  Genbank Accession No. AA446596
ttttgcagcttccactctttatttccaaagaatcagtgtcacacatgcagatcacaaagcgggtctccctgtgctgcttccttctgtgttttctagtctctcccccaggggctgcccagggccctcaggaactgagtgtgggcaagacactgctgggccagagggcacgacgcccacgtgggcccgtattgcccaggccatttggcagtgcagagcccccccagcctccagcaggagccccctggcatgagctctcccctcaggggtcctgagcaacgtccctgccagggctggtgggtggcagcgggggggcagacacctcgctgaggtcctgcagcag

SEQ ID NO: 1093 - DNA, 455 bp, Homo sapiens
  Genbank Accession No. AA446651
tttttcctcttaaattatttttcattctgattatattacaaagaaatgagctgtggaggtttggcactgttttccatcttaacagttgttctgtattgtaagattttatatgtgattcataatgtactactataacaagacacagtttttatatattactggaataatgcaaagaaaatgaattttcctttgggtccagtaattgtcaaaggaatgattgcagattcagaaaatgtgctttgtaataaccctgttaacataaagtatacactgaggaaaaaaataagtatggcacatatatggaaggattagttgtattagcaaggcatttcagggatggttttggttctttagactaagtaagatacatccaatttagacccccttcaaatccttagacaaatgggaatcacttggtaacataaagattattttggtgggcaggggctgatttc

SEQ ID NO: 1094 - DNA, 355 bp, Homo sapiens
  Genbank Accession No. AA446666
tttttttcctgctcatttaattatttttatttacacaactttttccatcatcatgatgcaaataagattataaatacacaaacactggagtacatgcaacacattccacaaaggaacaaaaatgtacagcactacagaatagagaacccaaatttttatatacaaagtgctttaaaaaaaaagaccttgtgacatattcaaaccatatttatttgaatactttccaataattaccatgggatacatcatttataaataatatttaatctcccctattttttcaagccagaatttgtgtttcaactaatcaagtgaacagccattccattatgtaatattaaaggcaagtcacata

SEQ ID NO: 1095 - DNA, 305 bp, Homo sapiens
  Genbank Accession No. AA446864
ttttataaatatgtaactgtatttttcttcctgtccagaaactgttattgaataaaattcaggtatattcctccaaaacccacacagttcagagattttcaaacaccaggtttccatttgtattaaaatgggcaagataatgaaggcacaggctcactttgtatcaataaaggacatcaaacacagtcatgaggcactaatgacataagcaatcacaaaaagcaagtgttcaaagtcttcagtaactcttctccctttaacatttggcaaaactcagtccagatattttaatacctcagaaagaa

SEQ ID NO: 1096 - DNA, 393 bp, Homo sapiens
  Genbank Accession No. AA446949
ttttaagtaaaattacttttattttcataaataaaaagacaacccattatacacttttagttgaagtaacatgttagttgtcactgcctagtatgaaatccatgtaatagttaacaaacagttacacctctctataaccttcatgcaacttctatacatttgataattccccaaaatttccaacatttcaaaaaacattatatataatgggatactttagtcacaaagtgtcacctttgctgagtcaacaaaatatttatatgctcatgtcaaagatgcctactgatgtaaagtaataccagtattgctgcattttacagaagcactgagcatattacattttccatttcgtatatggtagtatcatccccaaaaatgtcaatgtgaaaattt

SEQ ID NO: 1097 - DNA, 421 bp, Homo sapiens
  Genbank Accession No. AA446968
ttttggagtcaaaactctttattgtcctgcccagggagcccttcccaaaggaatccacagagcaggggggcgaggcgggcggcacagggccttggtgacaacgtgaagggggagctggagttaggtgggggacagccccttcagctccctgatggcactggctgtgctggcaggccacccaggggagccatcaccagcatgaggtccacacctggggctggggctgagtgctgtctacactgctctgtctacacggttactctggcacttgtcaggtccactcacctctctggcctcaaactgcagggggagatgggtccaatgctgggaggcactgggaggccgtggaacagtgaagagcggactgcacgggctggaggatgccagatgggcacacatgtcccccagggcagctgccggc

SEQ ID NO: 1098 - DNA, 400 bp, Homo sapiens
  Genbank Accession No. AA446970
tttttttttacttgtaatacgtattttaatttttgtttcatatgagtttaagtgttgtctaggtgacatcaaaatctaaggcaaacagacttgaccatcttcagacccactgcattctcaagctgaagtggtctgctcatagtttgtgtgccaggttgctcatcagtattgatactgtcccagaacaggttgtaggtataattcagagactgtcctttgcaaaggaaatgaccagcatttcaactgtatgtcttcctggaagggtagattctgctatatcttctttgtctgcatcaaaagactcaagaggaatgtggacacatttcatatcccatttgtagagtaaagcttcaagtgaccagtcagcactcctaacttgataagtagaccacaattggac

SEQ ID NO: 1099 - DNA, 243 bp, Homo sapiens
  Genbank Accession No. AA447118
ttttcatggttaagaatttcatttttattatactaaatgtcaggtcagaagtcaatggcatttacaagctggaagactgtttatccactcaactctttcaattatatcaaacactgattaaccaaatgtgactggacttaactgctacaactttatggtttctatcaagtatatgcaaatatcttaaatgggcacatatgcatatgtgcaaaacaaatgaaatatagatacttaaagaatgaa

SEQ ID NO: 1100 - DNA, 352 bp, Homo sapiens
  Genbank Accession No. AA447223
ttttttttttttgactgtataattttaatatttgaaaaattgcatccagaaattaatacaatacagatttgtacaaaaaaggaaggacgtaaaaacttctaatcatacagacaaaaatatgactgactaagcaaagattttaaaaaaggacaggatgtttaaaaaatactgataaatactgtgtaatgctttaatttactgtggcagatacaaaaatcaataattcattaacagattatatatgtaaaaaaagtaactacatgaattttctagctttttaaattaataaaatgtaacagtagtggtttttattttttaaatgaggtattattacactgtaaaccaaaaacag

SEQ ID NO: 1101 - DNA, 459 bp, Homo sapiens
  Genbank Accession No. AA447549
ttttttgacaagaagatacatttatttcactgcccaattattttcttaaaaaagcttaatgtttgataaaataaaacaaacttttagtaccatagaaacctttcaacatgtacaatgacatattattactatgtacaacttcaaaaacaaatgcttccagctgcaagtaaactgatgttgaacatcctgcctatatttcagctgtacgaaatttcctggatggccaatggtctccttggcttggaaaaaattatataaataagaccttcaatgagttgggaatcataaaaatgctatctgaaattcagtcatctggatcttgggaagtttgcaatagctctaagagttcaacaagcaaaataaaaccctggtggatatttaaacttcagttgtccaagacgtcttgtaggttcacagttggtctatcaaaaataaaagctattcctatcgtggcaaaca

SEQ ID NO: 1102 - DNA, 194 bp, Homo sapiens
  Genbank Accession No. AA447574
cacaacacagagacagacaggagcccgccctgctttaatgcgcatggcggggagccgagacgggtgcttgctggcgggggagccgagacgggtgcctgctggcgggggagagcgtgtccgggcgctgcactctgcgcagggctcttggatggcgctcaccacgtcacgtcttctgtgctttcggccaagcactg

SEQ ID NO: 1103 - DNA, 467 bp, Homo sapiens
  Genbank Accession No. AA447617
ttttttttttttttacaaagacatttattttccccaaaatatacccccagtttacaaaatccctccgagtcccacatttaaattagaagtcctcacatcttccattcctggggcagggagagatgacatccggaaggcatcagaacgtctgaagtctcactctaccagaggccaggagctggcacgagcgaagccaggaaaagactgccccagccccagaatagcaccatggtgggggtggggggcagtccccccggtgtccccaaagcattcctggccctgccctgccccaggctctgccttttctgctgctatgaaaggtccagagggccttggtgcctgcccacctgcccacacctggacagacattttggacaccaccagattctctagccgtgggaaggggctatggtcctctctccaggtttccgccccaaccccatgctctgggtaagaattatgggtgg

SEQ ID NO: 1104 - DNA, 283 bp, Homo sapiens
  Genbank Accession No. AA447687
acagtgcaagggttttaatagtccacactaaaataggctgtacagttttgtagtttaacattaaaagcaatcctgccttattttaaaatgcttctacttaagaatgcttcttcctcccccactccttcacttaaggtataagtctacccctaaagtgcatttctcaggcattaaaaacagcactgtgatttgctttccacagagtcctaaataacagccaccttcttcatttgagaggctacagagttcaagctgagctgtgacaggagccagggggccaggg

SEQ ID NO: 1105 - DNA, 398 bp, Homo sapiens
  Genbank Accession No. AA447732
tttttttgcagccataaaattctgtttaagactgtaacatggaaaaaatgtttatacgttaagtacaaaagggacataaaattgtatatacagaataacgactatgtaaacacaccaaaaatctatgcacagaaatgtctagggggaacatttaacaccaaaagattaacagtggtagcatttgggtggcaaacttgattctttctaaaattcccatattttccttaataagcagtaattataattacaacgggaaataatttctttaagtacccagtgcagtgtcactgtcaaataaacatcagtggctttggccccaattcttaaggtggcaaacgccgctgccccactccccacccatccccaatagggcttgagcacctgtagccctgctgagc

SEQ ID NO: 1106 - DNA, 396 bp, Homo sapiens
  Genbank Accession No. AA447740
ttttttttttttttccagtgctgaatgtttaatttcctatgaaaggctgcgagctagaggaggaagcaggaacacccagcgccgttcccgcccatcctcccgctccgccccgctccgcccgtgctgggctgtggcctccacacccagcagccgccctgggccgccttccttcgtcggtgcgtgcagcgccgcgctccttcagcttaggcccgacactccatgaactctcattttccaccttctccgtctccagcttccaagctgcacagggccaggccgaggtacgtgatggcgggcactgaattacagatcccgtctgtggccgccagcctctgtgtcctgccaccttctccgagaggacatcaccgccaccaggtggagcgagtctcctcctcg

SEQ ID NO: 1107 - DNA, 277 bp, Homo sapiens
  Genbank Accession No. AA447777
ttttttcaggccggaataaaggtttattgtgctggtgcattatatctcagcacctggagagctgtgcagaggttgggggagccccagatggagggatgggggagaggacctcctgccagagcctccctaaagcaggacggagcccaggctccctgtcgaggactgacgaatattgtggacacaggctgccagacaatgtgtgagcaacagggggtggccagggccccctgctccaggctgggcgtcagaaacccttccccagcccctcggacttccc

SEQ ID NO: 1108 - DNA, 262 bp, Homo sapiens
  Genbank Accession No. AA447802
taacaaatggatgactttattacgagagaaggacaagactgatgtttaccttggtcaaaccatccaggaaaacaaagcacacagacttatagaatactttggtttaaaaattattcataatatcaatattaaacctgatgtttaaagaacctaatgagaaatatagtgtaaaaaacaaaccatgaaaacacaagtttgcatagatgaattaatgtagatgtacaattggcatttaaaaaaggaggtttgcgttttgggagtg

SEQ ID NO: 1109 - DNA, 497 bp, Homo sapiens
  Genbank Accession No. AA447876
  unsure (1)..(497): n = a or c or g or t
tgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctangatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataac

SEQ ID NO: 1110 - DNA, 437 bp, Homo sapiens
  Genbank Accession No. AA447971
ttttgcccaaaatcatgaattttaaggaaagaatatatagagatggctgagttcaaaaggctcagtgttcaaattcagtttgttcctaaaatgaagagttacctatgtgggtgcaatatgcagctggtaaagtgattgctatttgctgtttgttgagattattcacccttgacttaaagcagcagtatctgatcttgtaaaatcctcaatttgcattacatcactttctctttgcgacttccttttctttcttgcatttactgctttgtaaatagctgttttcagtttataactgggactgatctttacatcagggtttctcagccttagcacttctgacattttgggaggggtaattctttgaggctgctttccttgtgtattataatctatttagcaacatccctggcctctacccaattcatgctactagtatc

SEQ ID NO: 1111 - DNA, 409 bp, Homo sapiens
  Genbank Accession No. AA447977
tttcatttacaacaatgcagtcatttatttattgagtatgtgcacattatggtattattactatactgattatatttatcatgtgacttctaattagaaaatgtatccaaaagcaaaacagcagatatacaaaattaaagagacagaagatagacattaacagataaggcaacttatacattgagaatccaaatccaatacatttaaacatttgggaaatgagggggacaaatggaagccagatcaaatttgtgtaaaactattcagtatgtttcccttgcttcatgtctgagaaggctctcccttcaatggggatgacaaactccaaatgccacacaaatgttaacagaatactagattcacactggaacgggggtaaagaagaaattattttctataaaagggctcc

SEQ ID NO: 1112 - DNA, 408 bp, Homo sapiens
  Genbank Accession No. AA447991
tttactttcattagtgttttcaatagtgtgggcgcagctcagaaggtggagaggctggcctcagaggacacccaggcttggggctaagtcccagtgtccatatgaagctgtttctggccttgtccgtttttgttgtcccaggctctgtgcccctcactcagtcaagaacttgtctttgtgttgcttcttggggacatgctcagggcagaagtcagagcggaggaggcgggaaaagtagattatgatcatcacgtccagcatgagcaggatacccagcaggaaggtgcccagggtcctctggttcacataacgcaagaagaaatgggtgaggtaggcctgagggggcaggcggaagagaaagtacatgaccaggttcacatacttgttaacccggtagaggagatgatc

SEQ ID NO: 1113 - DNA, 506 bp, Homo sapiens
  Genbank Accession No. AA448002
ttttgcagttacaacatttaccactttattataaaggctacaactcagaaacagccaaatggaagacatgtataggacaaagaaagatgtgggggtggaagaggttgtatggagcctccatgccctctctggatgccattggttgactgggggaattaattccctggtgcttccagcctgcaagatgagctccttcaaccagcaagtccccagtcaaaagagtgcacggggtgtagctggaagttgagcagatggtagtttgcatggatgagataaagccccaggggacagggcagctacacatgaatccaaatagtctaatctccaaaaggaacagagagtggattcatacaacataccaagcccgccccctaaatgcatcccactcaggtcacttataaagctccaaggatgggccaagaacacaagctctacaccagggaaacttggaggcatcagaaggacagaataagacccaggttcataggggatgaaaaatcgaacag

SEQ ID NO: 1114 - DNA, 297 bp, Homo sapiens
  Genbank Accession No. AA448252
tttgctgaagaattaagatattttaatcacatagctgttttacctgattctggttttgtttttttgtttttgtttttttgtttgtttttgttttttagcatccagaatacagggtacttgaaatcatttctgtaatatgcttcccaaacaggttttggaaggtagtctaggagctgtaatcacttattgctgtgtgtcttcaggcagtgttctctgtcagaggctcggagaaggttctcttgcttcttgtagctttgtgaggatccacctggcatcctctggggtcttgaagttaat

SEQ ID NO: 1115 - DNA, 426 bp, Homo sapiens
  Genbank Accession No. AA448282
tttagtatttgacattgagatatttattttgtgaaacaatgcaagcgattttaaatccccacatactatttgattaagtgcaacatggtacagtcatgtgtaatctctttacacgatagtgcatctagtccttagcctttagttattgcacaacaattataaagaccagtgaccaggacacgtggactctgacaggcagatcggcctacacaacgaaaaatcagaacagtacaccaactggaatggtcaaacaatttaagtcaaatgttttaatggtgcaattaaaataagggttcaaacatgttttcaatatattaatttctttaaagtcatgttcaggcaaggtgctgtttaaaaaaccactattagctttgtccacacatgtaagttatcaaaagttacccaaggtaattttgacgttgaatg

SEQ ID NO: 1116 - DNA, 423 bp, Homo sapiens
  Genbank Accession No. AA448300
ttttgtcgagaggaacgcacgttttattggaagtcttggcggcagggggagtctgcgggggcagggctggggaaggggcggcggagggggcggtgggcgcgcaggtggagcgtgggagatgtcaggtgccaggggagtcctggccggattccatcgctccaggtgtttctaccgcctgcggtcggacagacggcggatggagctgcggaaagttccctcctcttcatcgggttccccagtcctctgctgctggttgaacttgcaccggcatcttctgctcagcacgatgaggatgcccaggatgaagaggatcccggcgatgacgaggcctccgatctgcagggactggtagtcgtaagtgaacgggtcgtgttcctttggactttctgccttggccatggtgaggagacccacacagaaaac

SEQ ID NO: 1117 - DNA, 289 bp, Homo sapiens
  Genbank Accession No. AA449073
tttttttttttttttttttttttttttttttttacagaagtatttattttaaaagtagacttaaaaaagaaaagtaatttagattaaaagatccaaggtgtattgtttcatgtaggtgttactgctacctatactttcaccccatttattaagcccaaaacacttcaagcaacttcaggttcataaattaataaggaggtacagaagcccaaccaggatgggaaagaatgtgtttcaggttagaaggggacagcatggctccccaatgatgtcttgtatggaacatttg

SEQ ID NO: 1118 - DNA, 490 bp, Homo sapiens
  Genbank Accession No. AA449108
tttatttcgacattttattgaacttttcatattacacaatttacccaaaacatttaaagtaacagtaagacaaacttaaaaaaaaaaaagtcatacagacaaaacatctctaggtgaggcaatatgtaaatttcattgtcaaatcatgattttgttactctgctatacaacttggtaccatatcaatgctactaaatgactcaagagtaagacattatgcattccgtttatatgagaaaaagagattatttacaactacttgaaagagaaacagaaatgccaacaacagtatcattcaaattctagtgcaatgtcaattgttaccaagagatcttatttgcttatataaattttgcaaataattcaaacctggctatcttattagaagctgacaaagtatgcttttctgttgcaaaagatcagtggacaaaaatcctccacaacctcagctgataaaacaaatttaagcagcattttttttttccatttc

SEQ ID NO: 1119 - DNA, 538 bp, Homo sapiens
  Genbank Accession No. AA449122
ttttttttttttttttttttttttttttctccgtcctccaccaatttatttgcccatccgcaggaggtgacagctcctgtggtgtctgaccacccccaactccgaagtccagacaagctgtccgcccagaatatgaggctgacttgggcacactaggggaataccccaaaggcctgaaggaggtgccactgggctgccagcacttcaggaaggcacagggccccacacccccgagatccaagctgcactggctgacagggggcagggcggggggtggcgaggacacagtcccgtctgtcccagcaccggtgccaccctcctaagccccgggcaggcagtacgtacatgcggaccccgcctctcaaagcacgtttatggaaatgaacagggtggggtggcccgcgctcgccggtcacatgttggctcgttcccgctgcagccgcgagttgtaggcgcgagacacggtgttccaggcgtccatgtagcggtccatgcacatggcgatgcacttctgctcggagttgtccagggagccccc

SEQ ID NO: 1120 - DNA, 413 bp, Homo sapiens
  Genbank Accession No. AA449267
tgacagtgaaataatggttttttttaatgttcattactttaaagcttacatttaggaaactcaagctttgcttttctataatggttaacttttccatattatcataagaatcaactttctgattaatatttctcccttttttcttaagaagtcaatagttcttcatatccacagtcatgagtcatttttgaggacatgccagaattaccaatgtaactgtgaggcaggaaaagtacactcccagggaagtcagagtaagcctgtttccaccgcagcacagcagtgagcacagctaggcagaattccagcagagtgcaaatcagcatcagagagagagttccagccagactggctttggctgtatagcagtccgtggtataaagtgaatcatgataaaagtaagaaacataact

SEQ ID NO: 1121 - DNA, 503 bp, Homo sapiens
  Genbank Accession No. AA449297
tttttgtaatcctttaaaaatattttattaagcattgatttagaaaacgcaagacaagattgtaacacctcagggcaaaggcttgaaggtgaaacaaataacactataaatattgcacttctaaaatctttttttgacatcttcacacaactcaattctaaaatatccttttacagagatgtataaataaacgcttccaagctgtcaacgcttgacacttttagcttcctatcaccgcactaagtcggcaggtttccaatcagatagctgctcctctgacagcaggcaaagaacttccctcagctatctcggaggcctcatacctccatcatgtgaagagtcaaccagtcccatctttcggaatgctctttcagaatatgtaattttataagtatttttttttctactgagagaacatagatctttcaaaggcaatggcagaatacagcttaaatggacacagttcactgttaacattgcttattttttaaggcatccaggag

SEQ ID NO: 1122 - DNA, 490 bp, Homo sapiens
  Genbank Accession No. AA449306
ttttttctgaatgaaagctaattccattcttttatttcctcataccacaaacatttcaatttatctgcctttttacaacctgatttacacaagcaaattgcaaacgaaaaccaggcattctttaatcatccaaaatgcatgtataaaatatagaacaaaccctagtatttaaacataaacagggttagctgaagcagctttattgcaatctcttcaagttagcatattacagtttaaatatttatgcctgtaaagatctgcataatctacaatacagagttatttcagaagcagttgacttaactagttgagaaaaaaaaacaacaaacttcaacgcaaagctataataatttatccgaaacttatttacaattaaacatttagggtcctgatttacaaaactcagtgcctttcatgatttattgatgagttttatagagaaagtaagcagtatgtagaatattccccaggtaaaatctggagtgaatgg

SEQ ID NO: 1123 - DNA, 500 bp, Homo sapiens
  Genbank Accession No. AA449327
aaaggaatggaataacctttgagttcccgacaataagaaattggccaccttctcttcaattttggaccaatgagcgggacaggtttcagatttgatacatttcttagttttctcaaattactctgatctccaaaaccataaattgctgacttccaggtaccatcatgaatgctcaacccctcaggtcctgaatgtatagtcaggaaactttccacagcagtcaaagtaccattcattttatttctggtatatattactcccagatctgctggaatggagtcaaagccgctgcttccaatgatataaacccctttgtctgcagctttctcatgatacttcagttgcattagttccagaaactgaggttctccactgatgtcgatacaactggctccattttcaatacatgcttttattacaggttctccataaaaccgatatggtcctacgcaattgaggacaactgttgactgttttagcatttcatcaagcgaggctgg

SEQ ID NO: 1124 - DNA, 306 bp, Homo sapiens
  Genbank Accession No. AA449431
tttttatctgtaataattgccagtttattcctctggctaagagatccagaggtaatttgaggtttacatttctttttaaagttctttcatcaagagtttaggtgcccccattgccctcataagctggttgcaaattatttgactcttacttgtaaaaaaaatccttaattctttttgtgtgtgagacacgtgttcattaaaaagtacatataagcaaaaagaacaaaaagaagaaaacaaataaaatttcacaccacacagaaataagcttggttaagtttgtgatatatgttatatggatgtatg

SEQ ID NO: 1125 - DNA, 312 bp, Homo sapiens
  Genbank Accession No. AA449448
tttttttctgtacgtatgttttatttgaacatccacatttcttagcttagagacaattatattccgtacacttttcttctctctctcttacaatatttagactggccaaaaaccagggaaaatgtccttggactgcagtcattataaaattttacttaatgcttatgaaagcactcatgtgaaaagcttcagcatgaagtgtaatcaccacattcagtttcaaagttcaaatgcccattcctatgatgggtaaacacctaccatagcgcaaagaaggagagtgattgtgggtaatgacagaggaggaaaagt

SEQ ID NO: 1126 - DNA, 309 bp, Homo sapiens
  Genbank Accession No. AA449456
ttttttttttttgaggatgtgaagcaactttaatcgccaccctcagacggggcagcaggagtgtcttaagcacagggccgttctaccccctgggagctgcctggggccagcccctcagttctggctgtggcaggttccccatcctagctccccggatctccatagggagtgtccagggaccctcaatctccagggccacttctgcaggagctcgggttcgaggttccacgtggccagaagagctcaggtctctgagggctggtgtgcccgggtacccatccgcatcactgctctcctcctgtccggcta

SEQ ID NO: 1127 - DNA, 306 bp, Homo sapiens
  Genbank Accession No. AA449458
ttttttttcattgtttaaattaccatgtttatttatatcaacacaaaatacaataataaacacgacaaaaccattttatcttcatgtaacataactcttcagtgaacagaagtactactgttaatgttttggcctttccaaggtcctgcctggggtcaaaacagtattcagagaaagagcagattcttctctaccttccctaaaacacacacaaaggtaacttctattttctaaaatcccattccaataataattaaaaaaacaacagtaagtccacgtagaggagaggattgctgttgtgttatc

SEQ ID NO: 1128 - DNA, 388 bp, Homo sapiens
  Genbank Accession No. AA449475
cctggggtcagagttttaatcctgggaaaaagaatctggccgctgggcatgccctgggactagcccgctggtccctggtgtgtccgaatcagtgctccagtgcccgcctcttctccagcttcttctgtagctctgccgtcatgtctgccagcccggctgtggggaagagaggctgggctgaactgactggcagcttcctgcccaagccaccattaaagactttgggctctggaagagaagacagatgaggccaggtgtggtggctcacgccggtaatcccagcactttgggaggctgaggtgggtggatcacttgagggtcaggagttcgagaccagcctgggcaacatggtgaaacccctttctctggcttgggtccaacgggtggc

SEQ ID NO: 1129 - DNA, 424 bp, Homo sapiens
  Genbank Accession No. AA449479
cagatttttaaaaagccatttattttaaaaaactggtttgtcaaatcacatacatgagcagatacacaactaccaaagtggcctgtaatagacaccagtggggcggtcaccacacagtacctgaaaaatacagctaaaaaaggaggagtctgttgagtatttaatttcagatctacttgactccttgttgaatggctttaagttagcatatagtgagtgagaggtagagtcccaagtataatagctgatgcctcagggctccatttaaaaacaaaacaaaaacaaaaccatttctccctctgcacaagggaagcctatcctattttttttttcctttgcgaaaacagaagccaagtttctcttctcaaatggttcagcattcccaatcaaaaagtgggtgtgtggtaacctaggtattgtgctt

SEQ ID NO: 1130 - DNA, 364 bp, Homo sapiens
  Genbank Accession No. AA449828
tttttcaatgaacataaaataattttattaaatataacaaaaattaaaacataacaaaagtatcacagtattatagtaccatttaaatataacatagaaaaatactacaaaataagaaatacaaagacaaaagctaggtaagatttttatttactatgatgggtgtgcttgcctgttcataagttcattccagtctggaacacaggaagataatgctacccgcataactgctgcacaattcagcccatttctttcctttgtttttaactgcgttaagatggaaaaccctagttcacacaaactagttgttgtgaatggtagcaatagcaggacactctttctacttaacaatggaaagtcttcc

SEQ ID NO: 1131 - DNA, 386 bp, Homo sapiens
  Genbank Accession No. AA450114
atgagttcaatatttttatttctttacaatgatttcagaagagattacaaagagattaatatacttaaagaatcagactcttgcaaacagtgacatcattaaaaagagcttattttcattaacatgtgattaacaggaaggagatgattggtgagttttcttcgtaaccaggttcactgtggataggaagggcctgccttccttcccaccatggagatcctaaaatcacaagctccagcctccatcaatgatgacagggttaccagttacataagcagattcatcagaagccaaatacacgcagagcatggctatttcttctgcagttgcgaatcttcccgtcttttgtctcttcaggaaatcattccgtgcctcttcaggatttc

SEQ ID NO: 1132 - DNA, 431 bp, Homo sapiens
  Genbank Accession No. AA450127
gcgaccgctcactccccttctcctcctcctcttcctcttcagtctccaacgactctgcccccgatggtcctcgtgggttgggttgttttgggggggttgtgctgggggggagggggttcaaatatttattgtattttttgtttgtggcagcaactcaacagattctgctgctgggaagggcctcagcgttcctgaagagagatgtaggggacccactggttgttgccccggctttcttcgcagtagctggccacctccaccaagccgtggctcttccaggcgtccgtgtgagggttcgtgaccaggagacaatgcaggtctcgggcctcggtggtgccctgggtctcggccggctctcccaggagctgcgccaggcgctgcatgcccgacacccgcacgatgttgatgtcgttgtcacagcagaaggactg

SEQ ID NO: 1133 - DNA, 452 bp, Homo sapiens
  Genbank Accession No. AA450247
tttttgaagttcatcatctttagacttaaggaattaacaagggtcagggagactacaccaggctgagggcttcttggttcctggagacatgcccagctacagcaaacacagggaaacacgaagggggcagctggaagatttggtcttgaacttggggggtgggtaagtgatgatccccacgactggagcagcaggaagaagttgtgtctgaggaagtgctgggccgcccagagggacagccctgccctggagcttgtcgccgggagggaagggaaacaagccccctccctcagtgctgaggaaaaggcacttggctgggtctcctcctgccctctccccatccgtgggagagacggggtccttgcctccttgcccctttcagccgcccagaagccggtcctggttcagcctctggaagaagcttttgccgaactcataagtgctgatcatga

SEQ ID NO: 1134 - DNA, 380 bp, Homo sapiens
  Genbank Accession No. AA450281
caatcacagtacattttctttaattactttaatataaaagacagcagtttcacatttcacatatttgaaaaacatttcaaaaccctctaataagtatttaatgaaaataaatttatcgaagagaaacaatgaccacaaaattaatactaccaaatcattactgagactttttgcattacaatatttggagagtaggtgaagaaaatatagaacagaacatgaacattttaaaatgatattccacccaagctttatctttttgctaaatcttgtggacactagaatatatattcaagatgttggtaaagatattcagcaagccatacttcaaagatgttaaaacagccctccaccaataatatggcattgcaaacccttct

SEQ ID NO: 1135 - DNA, 380 bp, Homo sapiens
  Genbank Accession No. AA451676
ttttttttcttgttagctggatatatttctgttttttctttttttttctttttttttttttttttttttgtcacagaacactgtttgcagtagaggaaactggcattgcagtctggtggtataatggcttgtccacataaaccagtacatgttcatcctttagcgcaaaaagccctaatggcgcgtaccctattaaaattcaggacatctccaatattctctctctctgtttttctttgtcatcttttttttttttaaataaacattttcaaggtttgtccaaaagaaggccatataggttcttggctagcggaagacaattcagaacagctgttgcacacttggactgtcaccttctccaggctggcagttgatatctt

SEQ ID NO: 1136 - DNA, 446 bp, Homo sapiens
  Genbank Accession No. AA451680
tttttttttaaactcagaaatggcaaatagatttaatgcagagtgtcaacttcaattgattgatagtggctgcctagagtgctgtgttgagtaggtttctgaggatgcaccctggcttgaagagaaagactggcaggattaacaatatctaaaatctcacttgtaggagaaaccacaggcaccagagctgccactggtgctggcaccagctccaccaaggccagcgaagagcccaaatgtgagagtggcggtcaggctggcaccagcactgaagccaccactggtgctggcactggcactggcactgttattggtactggtactggcaccagtgctggcactgccactctcttgggctttggctttagcttctgctcccgcctggatccgggctttggccagggtccgatatcagcttcgtcccagttgcagggcccggcagcatt

SEQ ID NO: 1137 - DNA, 147 bp, Homo sapiens
  Genbank Accession No. AA451836
tttttctgaataaataagcatcaattttattgaatcatgaataatttaagactggtacaatcatcagctttattctctatgacatggggcatgatgtccagcagatcattggcaaatccaaaaacctcatgacaaatgaaaattaaa

SEQ ID NO: 1138 - DNA, 427 bp, Homo sapiens
  Genbank Accession No. AA451877
ttttttgctgtgaaacatcattttattaactaattttattttattttttacaaaaataaacaatttaaccaacaagaagtacaaaagattctggatattcaaactcgaggaagggggaaagcctggttttggctgctttgaggctttcattgaaagcaaatgaggcagaaaggccccggtcccacccccgccccaggtcctggctcaaaccacacctgctccctgaccccagtcttggctcatgctgaggtgtgcacctctgcccctgacccctgggctggcctgggagtgtcccctgtcgggaggtcagagatagcctccccaggtacagaatcacccacatcctggagcatctcccgccaagtctcctgtccagacctaagctgagagaacactccacgatggattgtccccacgcagcccccac

SEQ ID NO: 1139 - DNA, 452 bp, Homo sapiens
  Genbank Accession No. AA451911
aagcatgttatggttctgaaggtgtaatatttaaaataataaaaaatcctttttaatctttgggtcaaggagtaaacagtcttttctgcctgtggttgaaatgtcattgaaaatgagaatatggtactgcattcacagaaagtaacactggaatgggatttgtgggcattcaaaatagttacattttttattgttgagaaagaagatgcagaaaatgggtatatccagatataacgattaggtggagtaaaatgagctctatctagggtcttcctcagcattgcttctcccttgtctctaatttgaatgtctcccctgcattatgattactctgattcaattatatattttacaaatcatagcttctgtggctactgagtcatgttactctcagtactgaagttttagtgatgacaactcttccatggaagaaatatattaaaaagaaaaat

SEQ ID NO: 1140 - DNA, 495 bp, Homo sapiens
  Genbank Accession No. AA451992
gagaaatcgcttggacttcggggcggcctcggacggccatggcctttaccctgtactcactgctgcaggaggcctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttttaatgttgcacttgtagtttcattacaaaagatcagatcatgaaagg

SEQ ID NO: 1141 - DNA, 224 bp, Homo sapiens
  Genbank Accession No. AA452158
tgcggccgcaggctgcgtagtcctcctggcccgccgtgtcccacagcgccacgtccacctgcttgccgtccacctcaatgtcggccacatagttctcgaagacggtgggcacgtacacctcggggaactcgtccttactgaacacgatcagcaggcacgtcttgccacacgcgccgtcgcccaccaccaccagcttcttgcggatggccccatgagcggccggg

SEQ ID NO: 1142 - DNA, 460 bp, Homo sapiens
  Genbank Accession No. AA452167
tttgtagcagtccataatgagcaacttttattggcattagggtgtcagtcctgtccggatcatcacttaagtgtgtctcagtggagaaaagatcaagaatcatgtcaagaagaccatggggttttattccacttgagcaagagcaaatcagagccccatcaagcaggaatggtggcctttcccaggttccatccttaactaaactgactgttcccccttctgatttctccacggtcttctgtctcttgctctgccaaacttgttttcttatctctgtagagatgagtggcttgtttgatgttctttccatggcaaaaatttattcaatgcaaagttcacttcagacacttggttgagacttgaagtttagaccaatcctgagatgcgtggtgatcctgagagagagcagactgcctgccaggtaaatggtccatattagttccttggcagaggccctgac

SEQ ID NO: 1143 - DNA, 456 bp, Homo sapiens
  Genbank Accession No. AA452259
tttatcatgactttttcatagcatcttattttttggatgcatcatcttatctttccaaggaaattagggtttttggggtctaagttttctttggttcacgtattatctggttcctctttttttttttttttcctctctgttactccagtttatctcttttatgttggaggccctcctcagatgccttacccaaggctatctgtctatatctgagtgaggccctaaaaggctagccaagaagttctgtgtttggggtggggtggatggtagctaaatggcaagccaggctttttggagggactcccaaatgtctggatctggatggctgttccctagactgttcagtttttctggaaaggacttgtgccatctgctttctggggagctgctggtattctcagggtagggttgggagtggtttggcgctgagtcccttccactgtgcctgaccatggc

SEQ ID NO: 1144 - DNA, 417 bp, Homo sapiens
  Genbank Accession No. AA452454
ttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatc

SEQ ID NO: 1145 - DNA, 263 bp, Homo sapiens
  Genbank Accession No. AA452536
tttttttaaaaaaggaagtttattggtctttaaatggctcaaattgcaaataaacaaatcgggtagtggcatcagcctaagacacgtgatgcatctttgtcagttggcttcatagcacctcagtaccctggagaggaaaggtctcaaagcaaagtcacaatgttagtggttaggacccctggttaaataagactgtaataagtacacatggagattgctgggcccgctggccagtgttacattggtaacttgaattccgcaca

SEQ ID NO: 1146 - DNA, 367 bp, Homo sapiens
  Genbank Accession No. AA452549
tttgccttagacacagaagctttatttttctataaaattattcccgagagaaattttcttttaaatgcccaaagtaaataacttatatcccttcttgaaaacatccccaaagatagtctgtcagaaatccttcggtcaagcaggtcagctggctcccatggcccttggggtggcctgactctgtcactattcctaaaaccttctaggacatctgctccaggaagaactttcaacaccaaaattcatctcaattttacagatgggaaaagtgattctgagaccagaccagggtcaggccaaggtcatccagcatcagtggctgggctgagactgggcccagggaaccctgtctgctcctctttttccc

SEQ ID NO: 1147 - DNA, 366 bp, Homo sapiens
  Genbank Accession No. AA452559
ttttttgatgactaagtatttattgagacaaataatacaaattggtggcatacaaattattaaaaatagaatgctgaattttatttataggtgggccatcagatactgtttacaggttaagccttactataatgaactgcaaagaagtatgtatactgtttgaaatgaggaactttatccaggcaaacatgggatgtcaagagtggcctgtggtactggagacaaggaatatcaagtaattgacatgttacttgtctgtcagattttaagaatactgttatttaggcatattcaaagaaacaactgcctgttttaatagggataagtatataacgaaaacatttaatatccatacccccctcaaaa

SEQ ID NO: 1148 - DNA, 390 bp, Homo sapiens
  Genbank Accession No. AA452598
tttgaagatattaaaattcaggttttattatttgttcagttataataatttaagttaatatttgctgtattctcagagcaaagatgtatttctgtaccactgtcctgtataaatttgttacccaagatagtgactggtatgaaaggagagggaagagggtgacagatggaaacgattgctgtaggacagtccatctggccagatgcggtgcgggaggggagaagaagtgggagagagatggttctacagatgctcccatgggtaaatgatgggtgcatccctccctgcagtcgggctgtgctgtacttcacagtcctctaagaggtgtcattcaggccacctcactcagcctatgcccaaccccactcactttccctttccttatgggct

SEQ ID NO: 1149 - DNA, 476 bp, Homo sapiens
  Genbank Accession No. AA452724
cgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattattta

SEQ ID NO: 1150 - DNA, 409 bp, Homo sapiens
  Genbank Accession No. AA452855
tttttttttttactaaaatatttctttatttgaataaggtcaatgccatttcttgaattccagctagcatcaaataatcaggaaaaaaaaaacttgacaaaatgttatccaattgaaattgacagtggatagaaaacccttttaaactttaagtaatgtcataaaagaaatatattaaacaagcaacagacagatctaaaaagttccaagtgtggatttcacattagatcttataaattaaaaaaatcctcaatataatcatttgttcactatcttctttcaataagcacatggacagggaaagataatcacaccttaatattcacaactgctatttgtgttctttacaaaaattgtatctctgcaatgcagtgaggcaggcaatcccttgttcaagtcatttctgttt

SEQ ID NO: 1151 - DNA, 344 bp, Homo sapiens
  Genbank Accession No. AA452860
tttctgatgcataattttattaaagccagagatggactttttttctagagaaacagatctctgaggttagaatggaagataatgaaacaagagatttcactttataatttacctttgtcaaactatcccagagcatgtcaattctattatgaaagtattactttgacatcatataaccaattattaatagaaaacacacatgccaaaaaaccttaaattttgtaatcttcaagtcaatcatcaacttttcttgaatttttgaagacccgaaaagaaaaataatttcaaacaacagcactcaaacatcatatgcatttgtaatgaggcacagcaatcaatttttt

SEQ ID NO: 1152 - DNA, 279 bp, Homo sapiens
  Genbank Accession No. AA452915
tttttcacagtgtacactttatttcagactacaggtttctgaacataataaaatctttggcttgtagcggcggttcagtctcgcagtctgtggggtcgtatttctcaacaagtctccggaaaacgaaaggggggcagaacagacagaccgacagaagggacccgggaggtgggggagaagaggtgggcagacacgaaaggaaacacactctcgcacacaaagaaaagtcccagagaaaccagggccggcgatgcgggtcgggaggcaccggagaagcaa

SEQ ID NO: 1153 - DNA, 267 bp, Homo sapiens
  Genbank Accession No. AA453477
tttttcacagttctgacatttttattcactgatcataaatatagtctcatgagcattaaggtgatcatgaatgatgtactagcacctggaacatgaccatcatggagcactcactgattccccatcactggccaaagaagtcggggcatcttcctttcaccaagtgttcaactttggagggaccctccttctggtgcagcaattttattcttggcttgttctcaacaattaaaaaatcataaaagactgagtgtttgcaataaaata

SEQ ID NO: 1154 - DNA, 355 bp, Homo sapiens
  Genbank Accession No. AA453628
ttattcttaaaaaatttatttatagaaacagacatattcaaatgcaacactggacaaaaacaaagagaaaaagttggaatgccgatgacaacagagaatctcactttcactttccatttctctgaattagcaccattagttcagaaatcacagatgtaattataattgcttctaatatatagaacaccttataaagatctgtaaactatctaatagcaaagttcttccaaaaacgcatttaaaaatcaatcagaatttaccatttgaaactggtgaaaatggtttaaaaatggatccagttctaaagcttgtcaaagggaatgagccataattagttttattggaagaaaagtgc

SEQ ID NO: 1155 - DNA, 510 bp, Homo sapiens
  Genbank Accession No. AA453656
tttgtagttgctgaaaagaagtttattgctattttcttattttattatacaaaactagatttgcttaaaacatttcccagtctctttaaaggaatgctagttagtgggaggccacagctagtaaattaccctcagtagtggtttcaagtagtccataactataaaaatcgttacggccaggatatgccggaacagaacactccccactggggtcctcagccttggatgtcagctcggcccctcaaggggtccctacacctggaagctgattccactcatcagtctcgagctgggcgcatgtggagttgatgtggagttgtagctgactggctggtggggtcagcctggcctcccagtgtggagcatgggcaccagcctcactgcgtggtcaccctagggcatatgctgcgggctgttgtggcattcctgtggccagcccagaggcaggcaggggctgtctggggtttgccatgtgcaccatcacctgggcttggggtgagctggaggagc

SEQ ID NO: 1156 - DNA, 452 bp, Homo sapiens
  Genbank Accession No. AA453757
tttttcctgttacgccgtcaatgcagcaggcaatgaggggaatgacacagccctctcattcccggaacgtagtcaatctcggctctgcggatttcacagaacacactttgcctattgccggctccaacaagaagtaactttccaggaagctgccggccccggacgcgccaggatcgctgcctgcgctgcgctggccgccggggattcacccggggaggcggggccgcgggggaaggctcgcggggaatacagcacactttcccctaaatccctcgtccgcgccgagtgcagggctctcagagttcacctagtcccacctctcacccacaacagtttataaatggggaaggtcagacaagttagtagcagagctgggtctagaacccaggagttcgaatgcaatccgaggctcatatcgagactttaagttgtccgattccgaagtttatttg

SEQ ID NO: 1157 - DNA, 419 bp, Homo sapiens
  Genbank Accession No. AA453770
tcatggtccaagcatgtggtgatttttattaagaataactttggttctaagaattccaccctcaattctttaatactttccgttaaaaacaattatacaagagcaaatacaaaaaatattaaattatgaaaaccaatccattaaggctccctttatatatattatatacactcaaacaagtcaagatttttcagagtagaagaataaagtcgactgttatagcttagaaagcaacactactactatgagactataaaacattaaactattttaagaaaaccacgctgtggaaaaatggagccatttttgtcaaaaagtggctcaaagcacaaaactgctcagatgttcaagagtcctaggagtttgggctgcacagtattaaggggtgagaggagaccgacagcctgtttgaatcaggc

SEQ ID NO: 1158 - DNA, 310 bp, Homo sapiens
  Genbank Accession No. AA453783
ttttatcaaatgaatactttattagagacataacacgtataaaataaatttcttttcatcatggagttaccagattttaaaaccaaccaacactttctcatttttacagctaagacatgttaaattcttaaatgccataatttttgttcaactgctttgtcattcaactcacaagtctagaatgtgattaagctacaaatctaagtattcacagatgtgtcttaggcttggtttgtaacaatctagaagcaatctgtttacaaaagtgccaccaaagcattttaaagaaaccaatttaatgccaccaaac

SEQ ID NO: 1159 - DNA, 487 bp, Homo sapiens
  Genbank Accession No. AA453917
cggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtgg

SEQ ID NO: 1160 - DNA, 316 bp, Homo sapiens
  Genbank Accession No. AA453988
ttttttagttgctccttgagtttttattcattgttttagcaggaactattaacaaataaaggctttagtttcatacaaacaaactgacaaaaaagatcttatttctctagagggtagggaaagtataaaattctgaattttcatgtcgagtgtgagccaagttagaggaacttggccacctgcaaaccactccctccctccatgggaaggaatctgaggcttcctaggtgaccaggagccgggcttcttttgttgccttaatttcctttcacctgagagaaaatgaaagccagggtctttgtgctccaggccaagg

SEQ ID NO: 1161 - DNA, 419 bp, Homo sapiens
  Genbank Accession No. AA454086
tttgttgatggagaatgttttatttatgtaattttcatctgtagagatgcttctgtcctcatctttatatttgtctccctcttctcattgaactgcaaaattcctgaaggatgagacctgggatgtttaatgcaaactgtacattctcagcagagcacaagtatcaaagggacattggatatattttaataatgatctaacacaagcaaaaataaccactgaaaatataaaactcaacaagagacataagaaaaaagcagacagaaaacaaaaaaaattcttattttagaatgatgctatatgtaacttgtaaaatatttaagtttttatacatgagattatattggtttccttatttaaagaaaaaaattacaattaagaatggaaattaaaatgtaaaaccaagataaatatttttg

SEQ ID NO: 1162 - DNA, 438 bp, Homo sapiens
  Genbank Accession No. AA454159
tttctgccagtagccctgtttaaactcttgaaccccagtcacagttttccagaagtccatcaggatagaattttcactaatcgccaaatgcccaaagcttagttctttcttagaaggaaaagaagaggtcaaatggacaggagagagcggagattggttgttctcaggggctccttccctttgcctgcttctttcatttgggacgccagaccttgacctggaagtgaggtcactattgggcagtggagtgtgagaaaggactttggcctgggggctgcaagttacagattaacacggggaggggtgaggagggacccagagggaggaaaggtggccagaggaagggacagctgacctggcacaatctgggcttgaagggggcacaacaagagcgtctgtgagctggtgctgtctggagggatcttggctcctctccgg

SEQ ID NO: 1163 - DNA, 265 bp, Homo sapiens
  Genbank Accession No. AA454170
tttgtagagagaaaaatttattgcaaggcagccaagcaaggacacaggagtctggcccaaatctgtctctccaagttggaggctggggcagattttatatacagagggtagtgaggcatgatatgattggatcttgtaatgaggggattcaggaggcttgatctgactggatcacgccagggctcaatctgattggatcaaggatcatgccacgtggtgtccacttcttaactcagtccctgttcctcagtctgagcacttaggt

SEQ ID NO: 1164 - DNA, 412 bp, Homo sapiens
  Genbank Accession No. AA454177
tttcttaggaaaagggtctataatatttattttgaatatggaaccatagttctttttccctaggttgagaaaacttgagcaaaattagttttatttaggcctgtggtttaaaaatattgagatacaagagtttttttttttttttgagatggagtctcgctctgtcgcccaggctggagtgcagtgatgtgatctcggctcactgtaacctccgcctcccgggttcaagcgattctcctgcctcagcctcccaagtagctgagattacaggcgagtgcaccacgcccagccaatttttgtattttagtagagatggggttttaccatgttggtcaggctggtctcaaactcctgacctcgtgatctgcccacctcggcctcccaaagtgctgggattacaggtgtgagccac

SEQ ID NO: 1165 - DNA, 559 bp, Homo sapiens
  Genbank Accession No. AA454184
  unsure (1)..(559): n = a or c or g or t
ttttttttttagataaacatatttttaatggaatacctttaaaaatgcaaatcaatgcacaaagaaaacgcccatgttgaacaaaatggtgacaattgtgccttctcttcaacaccaccccaccctccagaagtttccttcaagccgtaccttcaggtgaaggtcagcgcacactggccacccgggaccacattttccagaatcctttggcggtcccgcgatgctctcgtggtcagcagctctcattgggttgcagaggagaaacttgtccgtgtcactggggcatcttaacagtcggctcctaagcttggttgtgtgcgccgcaacnngtccgcgcacgcctgaggctgggatgccgcgctgcctcgccggcgatctgtctgagttttcttcctcctggggtttcttcctgctggtggaccctccgcgaatcccggcctccggagaccgtcctggtaaatgccctggccaggactggtctcagcccagattcagacgcacgatcacacagggctcctacttcgcccctcgtgccgaattcttggcctcgagggcaaat

SEQ ID NO: 1166 - DNA, 434 bp, Homo sapiens
  Genbank Accession No. AA454597
ttttttttttaagttgaacagaacattttatttctcagcaattctatgcgtacaaattaaacatgagatgaatagagactttattgagaaagcaagagaaaattcctatcaaccccaaggaggactcaaagtgaggctggaagaggacttagaagagtatgaaagtactctaagattttatctaagttgccttttctgggtgggaaagtttaaccttagtgactaaggacatcacatatgaagaatgtttaagttggaggtggcaacgtgaattgcaaacagggcctgcttcagtgactgtgtgcctgtagtcccagctactcgggagtctgtgtgaggccaggggtgccagcgcaccagctagatgctctgtaacttctaggccccattttcccctctgaaaataagagggttggatcaaacgatctctgggg

SEQ ID NO: 1167 - DNA, 297 bp, Homo sapiens
  Genbank Accession No. AA454667
ttttttttttttttttattttatgaaaatgtttaattcaactgtttctttggaatgtagtagtcatagtttggaatttaagttacagttcagttctatgtggtttttatgctactcagtgtctgagaatacaaatgtcatttaaagttaaggcttcgctgttcattttgaaacaacaatttacaagtgtcatattgtcatagaaaataataatttctgtaaaaaaaatctgcacaaaatcttatgatggtacaaaacatgaagcaataatataccagtaaaatgaaaacattttact

SEQ ID NO: 1168 - DNA, 82 bp, Homo sapiens
  Genbank Accession No. AA454710
tatttttgacctgtacaataggcactttattagtggttggaatgcagttacacgcaggggtgtgcagacgcaatgggggcag

SEQ ID NO: 1169 - DNA, 386 bp, Homo sapiens
  Genbank Accession No. AA454733
ttgatattttaacaaacgttcctttattaggttactgactattatcaaccatcataaaatagaacgggagtttcaaaactgtacaagccacaaggtctgggctggtaggaaagaagggtggggtcgagggtcccagggtgtcggggggtgggagatgcagagagagctagagggtcacccggcatctgtgaggacggctgggtcaaggccataagctgggatctgtacaagggaaacattcatcagaatgtgacccacctgaaacaggagggaggaaaatctttaaaagtcttacaggtaaggtcccctgccccgaaaaaaaaaaaccgtcaaaataataagggggtaatgtacatttctcacccagtcttggcaccaattttgtg

SEQ ID NO: 1170 - DNA, 194 bp, Homo sapiens
  Genbank Accession No. AA454830
aaagaggcacgatctgatttatcagtttctaggaaacaccctctgggaggaaggcaggcagcgccgccggagaccttacaaccgcccgctaaccggggaggggggccggtagggcgcctcgggtctcaaggcgccgggagggtctgcgggccctgaaggtccctgggtccgagccacaagtcggggcagaaccg

SEQ ID NO: 1171 - DNA, 379 bp, Homo sapiens
  Genbank Accession No. AA454908
ggaggaggcccctgtgagcccactctggaacccttcctggaaccctccctactctgtccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgaggcaggcctagcctgtggagcgggctagggccaggagcatttggtgcccctccatgttgcaatgcaaacaccttcaccactggggcagtggggagagatggctatattaataaaataacgtgtgtctttc

SEQ ID NO: 1172 - DNA, 394 bp, Homo sapiens
  Genbank Accession No. AA455097
tgtaaggaccagatatagcctttaattcctaatgttcaaaaacaatcctgtcttctaaatcacaacttttcgagttacaagatttatccacttcaaataaggataccttttataaagtactttcttgtggttttacagatttcaaggtgcttctacgtggcttcagcaattctcacaacaaaccctcagtgggtcagggtcttctaagattaaaatgttaacaccaatgcgtgtgaagtacagtgaagtacagtgaggttaaggctcagtggcaaacgttaaagaggcccacacaacacaccagggatcagagccaggtcaaattcttgctccccacctccaccccacctcaagaagaaatttattttttgtttttatttttagaaacagtctc

SEQ ID NO: 1173 - DNA, 308 bp, Homo sapiens
  Genbank Accession No. AA455111
gaggtacaccaacactggtagctgtttaatatattcatcttacaactggatgctaaaaatgcaatcactgtaattaataaagttgaggaaaacacaaagattagctaacaggggtaaaagatcatttagagtaaaataaatgtgtacattctctatgttctcaatcacctgggaaggcagtctatggaatatcaggaagtaagagttttcttgttttcaggaacatggaggtatatacacttcagaattcagaaggtaactggggctataaatagtaattaaaagaacaaaatagaagcaggggggtt

SEQ ID NO: 1174 - DNA, 411 bp, Homo sapiens
  Genbank Accession No. AA455239
ctctttttccttctcgagggcattgtttctggttgttgtttcattaatgatattgttactcttggcaggtatacttttaaattcttcaaccttttctttatctttttgaagttgtttctccagttttttggctttactcgtggcatgttttaacttttctctaacttgaacatcttccaaatctagctgtgtaaatttttctttattctcctcaataaattttgtaattttattcagtttcttttttgtatcttttacatctttattcttagctttcatttcatttgatagtatattgctcttctcattaatttctttggtatcttcatgaattttttccttttgagtttccatttcagcaattcgtttctgcaactcataaatataatattgacaaacatgattcttttt

SEQ ID NO: 1175 - DNA, 427 bp, Homo sapiens
  Genbank Accession No. AA455261
tttttttttttttttttaaatcatctttaatgtatttttaataatttttttgcctcatttaccagataaatcatctaaataaatagatgctatacagtctcttaccaatgtcagtacaaaaataaaaccgcgctctacatccactctgactctcccagcacacacacactcagcaaaggcatgtgcttggaatcaactcgtgcccccgacccctcccagatacattcatttagtctgaacaaagctcgaagctcattctgtgcaaaggaagcgctcttgtgctgagacctggtggccgcagctggccacttcgaaagcaaaagctaaaccacctcacagaagcacagcgcctgcccccagaacaaggggacaggaggagcttggcaacgaggtcatcacccgaacagcagtgacagtcctgcattcc

SEQ ID NO: 1176 - DNA, 185 bp, Homo sapiens
  Genbank Accession No. AA455367
ttattttcataaatgacttttacttatcatttctcttgacagtaattcttggcaatgtgcatataacatgaagggaagcataactttcagaagtcatcaaagatattatcctgttgtcctcattttcttaaaccattaaaatattttcatttataaaaattaatctaaatataaatattgacact

SEQ ID NO: 1177 - DNA, 443 bp, Homo sapiens
  Genbank Accession No. AA455403
aagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtgggcgggacggaagagcagagggagcatggccaggggtgttgaggccagcggtgagagccgtgttagccaagacatggaactgtgttctcaagggttatgtggggcgtgggctctcatagtgtgtatgaaaagcttgttgactctagcggctcacagaggactttgctgggtttctttgtgtgaatatctccgtgctgaccatgctggaattggatgattctgcaattcgggacctactgcaggggtccgtttagtaacgtcttgtctgtgatct

SEQ ID NO: 1178 - DNA, 342 bp, Homo sapiens
  Genbank Accession No. AA455521
tgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtg

SEQ ID NO: 1179 - DNA, 240 bp, Homo sapiens
  Genbank Accession No. AA455522
gaagttcatcatctttagacttaaggaattaacaagggtcagggagactacaccaggctgagggcttcttggttcctggagacatgcccagctacagcaaacacagggaaacacgaacgggacagctggaagatttggacttgaacttgcgccgctgggtaagtgatgatccccacgactggagcagcaggaagaagttgtgtctgaggaagtgctgggccgcccagagggacagccctg

SEQ ID NO: 1180 - DNA, 333 bp, Homo sapiens
  Genbank Accession No. AA455865
tttttcctcatggtgtagttttattgtttcttccacgatattcagatgtgcaaaaaatttcacaagaaaacaagtcagcaagctcttaagagggcagcaaattcttcacaagtcagagggctcttgaacccacaaaaagacaagaagtgagtgtaagattataaaatgttaatgatgaaattccagaacaatgtacttttctcaagctctgctgcaaatttaacacaaacatcagtgttaattacactttgtcatgtatgactgagcttgctttaagctcttacactgaaaggaagtctcatttcatgcacaaaatctgttgcatgcctggct

SEQ ID NO: 1181 - DNA, 416 bp, Homo sapiens
  Genbank Accession No. AA455896
ttttttttaggtttccagccttttattcatacaaggactcaaaagaacacacgtcacccgctgacactgagcggtggggggaccttgtggaggaaggacacagcaggcttggccactgccctgaccagtgaccactcagggctgccccttccagagatgagcgtagggtggggtctgagcgccacccctaggccgtctgtgtgcagcgggagtgctgctgtcctggcgcccggcatcactgtgccagagtccccagcccaccctggcactggcagggttattatggggtggacttgcctgtgttgggggctcctgatcccaaaacatctaaagtcaggttccagagaacaagccatggggacctgaccagcaaccggggacctccgtccactgtgcgggacggtgatgaaaagcaa

SEQ ID NO: 1182 - DNA, 393 bp, Homo sapiens
  Genbank Accession No. AA455962
gcaggttcccaataatcggtaagttaataaaatgaatatattttgatggcagaatgttgaaagacaagaaactaataaaaagtacttgtttttagctggaactagcatttggaagtaatgctagccagaggtaatttccactgtgaaatgcacactcaaagtcctattgtaatattattttaagggtcttaggaggcccctcagaggagactgcaaggtcagggctagagtatgagaagtcctaagggtttttgtattttgttttttttttcctataaaccctgaggttgaaagctctggatagctcacctaaattactttcctctaatctaacccctcacagcctgaatttctgagtattgcttgaccagtagtgacacattcctgaggcac

SEQ ID NO: 1183 - DNA, 346 bp, Homo sapiens
  Genbank Accession No. AA455987
cagtcattgtatttatttaccagcatttatggcaaatggccagacctgggcagggtggtagcaatgatagattttacaaattaaggcattgttctttatttcaaaattttcatttacctatattttccttggtcttagaaatatgaataatttagagctggcaatactcaccatcaggatataataaacggaggtttctttgtctgaaatccataaaatgtagtaatactctattgtacttttaaaaatcctatttttgcagttggcttcctctcagtgaattagttaggtagttttggtacatttggagggtcataaacatgtcatagaaagagtactggcatta

SEQ ID NO: 1184 - DNA, 315 bp, Homo sapiens
  Genbank Accession No. AA455988
ttttttttttttttgcaacagagcagaaaggatgctttatttgcaaaagagtggtgaacatctaaaaagttgacattgtatatgattacaaagtaaagagtactcttgtgagagaagttacatgttcattgttaaggaaattatatgtaaatcacaaagatcatggtctgtgaataatgtgccatatctcacaaaatatggtcattggaatcttattaaaattatctacaggtgacttcagtttccattctccaccctctgccttaagatacgaagccttgacatgaccacatcccagtcagcataagctccttc

SEQ ID NO: 1185 - DNA, 321 bp, Homo sapiens
  Genbank Accession No. AA456055
tagtgtgaaggaacctatattgtaatgtaatttacagaagtgttggtcaaagtgagttcttttccatatagaaattaaaaggtagtaattcaagaccccattgccactatttggacttaactactgcactacttaaagattttattgtatagcttggacaaaggcacaagctttatggaagagcaattctgggtaataattacataatgacattggggctacaatacaggtaatgaaactctgcttcttcagagacagcaccccaggaacactttcattttcctcttaagcataggccattttctcagtttagacaacagc

SEQ ID NO: 1186 - DNA, 448 bp, Homo sapiens
  Genbank Accession No. AA456075
aaaatgtactatttttaatgggtgtgcatgtcaggattttctttagaaatacactggtctggtctaatttatttaagcaggagcactttaaagtatcccaccctaccccattccacccccagtggacagaaaggaaattgactgacttgaggggatgcagacatctgggttattccaacagaccagtggttaggaggagggggtgggtagcattatggcctcggcagagccccccaccctgagcctctgaaagctgactttatctgtaagagggaggtcaggctcgccttctcaatagcgtgtatttggatgagatgagtttcttctgtaaagagaaaaagatgttaaaacctcattgtctaaggcccctcatctgagaagtcttgtctgaccctctagcccagcaggaccaaggtgtggtgcctggtcccagcctgtcctctgctcc

SEQ ID NO: 1187 - DNA, 388 bp, Homo sapiens
  Genbank Accession No. AA456080
ttgaatttttggcttatttatttaaaaaaagtcaaccttatacataaatagaataaaaacaagaactctaaacaatcacaaatgtctctacaaaataataaatatcatggaagttaaacatacatataaaactttactattaaactaatctcctgtatgtatatttttataccctgctccccccaacaaaaggatagtgtcacatgctcaaaccatttaagtcttgcagtgtagttaccctctgttgttactgctacattctaaacataaggttctcattgtgtgttcctatacctaaataaaaaacagctaggaagtgcacttctataatccaaattctggttcagttatgatcatatctgtacctgccataatatacagcagaatg

SEQ ID NO: 1188 - DNA, 433 bp, Homo sapiens
  Genbank Accession No. AA456147
tttttttagatttttaaaaactattttaatacaagattaatagcaattttctatccaaatcagaaatgaaaaatcttaacccaaataatattcatttgacagtcacataaaattttagatttgattggtgcacacatttatcctgcatatatattatgtatatgcacagagagacctcactattatgccattgttaggggtctttttttggaagtacctcattacaaggcaatgtcaaaggttccagtaactactcaactttgaatgaagttcaaaatgtccccatgctaagctgagtctgtgccatagcaaaccatgatatagcaagtctccagaatgtgtacaaatcaatactctgtttgtataagttggtctaaaactaaacactggctaatgtctccaacaaggaggaacacattacaaatttataagt

SEQ ID NO: 1189 - DNA, 397 bp, Homo sapiens
  Genbank Accession No. AA456289
ctttttttcattttttagtgcacatatgtcataataaagtaatgcccagctaagtgctataggggaaggcaaagtatgctggctggctataggaagtgacaccatacactgacaatcacaccatacaacagcgccaaacgactattcaaccacttatcagacacatatgaaaatccaaaatgttttattttatttttttttccttaaatagagataaccagtaaacaattttcagaacttggaagtttaaaaacgtgcatataaaaatgggcattatatactttttattgaatgtggattgactgcagtctgctaagaaaaatggggtgtgggagctgaagaaaaaggaagttgtctttttttttttttaaggcttgcttgtgaaaggaacagttgt

SEQ ID NO: 1190 - DNA, 421 bp, Homo sapiens
  Genbank Accession No. AA456311
tacagtggtaaagcagcagtttttatttattacaaattctaaaaaagaatccaactttataagtaaaaaggaacactgatgatcacttaaaacatttaaatttaaaattactactaaaaaaaccctgtacattcacacaagtccaatgcctttgttggtttttacagacatagaatttctgtagggttttgggccctatcaacaatttttattaagtactgcaataacaaaatacagcaataaaacaactggacactcctaggggacaccaaagataaagggcccattaatcaggtgtaggccagagaaacccaacctgttggcaatatgacgctctttcccaactgggtcttggtgagacacgtggcacagcaaggctgtcagtgcatgtgcataaattgtagaccaggtcccactatgc

SEQ ID NO: 1191 - DNA, 440 bp, Homo sapiens
  Genbank Accession No. AA456326
ttttttgaatcaaccccaatgttttatttaatttaaagttttaaaaggcagtggttaagcacattatgtatatatgtatatatatgaatgtatgtacgtgtgtatatacatacatatatatacaggaaaccaaccccttttcaactttagccactgatgagctaggcccactgtctagtgcatgactcactttctacttcttcataggaccaattctaaaagtaaaaataaacaccctttatcagtttaacagtaactaattgtgtttcttttttttaaataaataaagttactattaaactgatcacatatggtagaaacgtagaactcacacacacaccagcacacacagtccccaatttaaaatgtgatgtatgaatgacctatatgtacaaatgggtgctgctgactcccccaccccaagcagaggccatgaaaga

SEQ ID NO: 1192 - DNA, 379 bp, Homo sapiens
  Genbank Accession No. AA456415
aatgtgcagtcaagtttctctctttttttcttctaggaatgataccatgccagtaaatccctacagaacatttccagtttggcaacaagcagtcagtcgatcattcacatttgtactcaagacagcaggcctgggcaaaactcgcctgaatttcaccctgaaaagtgctccccatcatctgaagaagcagcacctggtaacaggcatggccattcagagggtacttagcattttcatttcacctggggtcttgaagcacttcctgaaaactgattgtgccttgacatttacctgtaaaaagaagtgtaattctacccctttggcagatgtgtaaactaagacggtgcaaggcccacagaagtaaggagaggaccaggaa

SEQ ID NO: 1193 - DNA, 196 bp, Homo sapiens
  Genbank Accession No. AA456583
cagagaactgctttattgatactgcgagcctgggcttggctgcccactcaagtggtcctgtagaaaatacctgggagctggagctgttctggtccagaagcagtcaccgccacagcagagggaaacaaatcctgacaggaacagtctttctggggatgggcagggatgtgcagccccaggtcggctcctgcatttg

SEQ ID NO: 1194 - DNA, 317 bp, Homo sapiens
  Genbank Accession No. AA456589
agtataaggataagcaagcttttattccgtcaagagaacaaaggtcaggacttttatcctggtggggggatggggagtccagattccttctctgatgaggcaaaaaaagaatcaagactcctgttcaagtaaagggcagagggtgagagctagtactcttattctagaaaggaagtagatacttttctttgataaaggaatgaacggtagactcctagtttgcagaaaaggtgggaaagatgtgacttgtactttggtaaggagatagggaaggaattaaggctattactctgaagaaagttggggggccagggctc

SEQ ID NO: 1195 - DNA, 427 bp, Homo sapiens
  Genbank Accession No. AA456612
tgcggccgcacgaactcaaacaccggctcccgcatgtccagaagctggtggaagatgtaggtgacggagtcatcccagcggcactggaagaaggacaagccggctggagtcatggtttcttggtgtttcttgtagaaatcaaaagtgcggaaggtccgctgggccagctgatagcagggtgaggggcgtgcgtcctcagagaagtcaatcggctggtcctgcttgaagagcaggaaggcaagacggtggatgccggagcctcgggcagggaagggggggaggtagggacacgtcacctgtccttcagccacccggttacccgggatgttggttagcagccagtggaggtactcagcatctggctccagcaggtgcccatccaagctagtgagtagcaacgtccacaaggagccctcttctgcctcat

SEQ ID NO: 1196 - DNA, 382 bp, Homo sapiens
  Genbank Accession No. AA456646
ttttaccaattaatcttttattttttattgcatacatcaatatttaacagaagaaaaataaagaacccctaatgttaaactgaattacatgttatcttctgattcttttcaatgtagacctaaattttcacatgtatcagtaaacacaatttatgttcttattaacatttttgaatctcacttttttgcatacaatttgacatatatcaatattattgaatggctatataacattctgtgatagcactagcaatacaccaaaatttacttaaccatttccaatcgttgggcttttttcccccttaaagttatctgagtggaactgctagaaaactttgtacaaatagcttttctttcttttaaatattttcctgggcatatg

SEQ ID NO: 1197 - DNA, 342 bp, Homo sapiens
  Genbank Accession No. AA456687
tttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaagaaagacaacttcctttttcttcagctcccacaccccatttttcttagcagactgcagtcaatccacattcaatgaaaagtatataatgcccatttttatatgcacgtttttaaacttccaagttctgaaaattgtttactgg

SEQ ID NO: 1198 - DNA, 381 bp, Homo sapiens
  Genbank Accession No. AA456845
acttttaaacttgtctctaacttagaaaattttttctaaatgtatcgattagtgtaaagaaaaagtatgagtagttaataaatctgacctattatacaagaaatgcaattttgaaataccagattttcattttttgtactaagtgtatctcattgtaggcaataaaaaattgcatcacaggcatcaaaagtgggaaaaaattgttccttttatcaaccaaatagaaactttcaataacatactttgagtgataaaatggtgatgtcttacatttaccattatagagaggtcttgtggttagaaatttaaaaagtgtttaaagatgattaagcatagacaattaaaagaaacattatatctcttggtatttttctcaagaca

SEQ ID NO: 1199 - DNA, 211 bp, Homo sapiens
  Genbank Accession No. AA456852
caggtgacgggaattaaataacttttgactttatttcactagagataaaaccagcagcatcacagcttggtccccttgcccacccccttgtcctccccaccccccactcttctgcctaatgtcggtaatgggggcttcgggatcgggaccttgagcgccttcgagaagagctgtattctcgactgtatcggggggagggtgagcggctctg

SEQ ID NO: 1200 - DNA, 355 bp, Homo sapiens
  Genbank Accession No. AA457235
aagtgcttaagatggtgtttaatacagcagggagccaagatacagtagtaggacacagtaaagaatgtggagtgtgtagatacaataaagaattcattttatgatctgccacctgttacttgacagaggagtaagttagggaaataaatgactcagttcttcatacatgcaaaggtaagttagttattacaaaagtttttgctgttgtttgtgctgaaagaaaagcatatgcatttaaacattttttaaaaaataaatcactcaataggcttaagaaaaatactttagttcatagttcattgatctgacgttttgatttaagatcaggggatgaatccaggatgaaaaccaaaga

SEQ ID NO: 1201 - DNA, 379 bp, Homo sapiens
  Genbank Accession No. AA457377
  unsure (1)..(379): n = a or c or g or t
ttctggtgcgacaccatccacacgggggtctaccagtcctatcccggagcctgagcgagatggcccaggcaaggaccccacagagtgcacgtgcacacgtggnnctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgccgtcctccacggagagggaaatcggctcttcaagctgggccgctacgtagaggcctcttccaagtaccaggaggccatcatctgcctaaggaacctgcagaccaag

SEQ ID NO: 1202 - DNA, 358 bp, Homo sapiens
  Genbank Accession No. AA458652
gttccaaatgtttaattttttaaaatagacaactacctttataaatcatacacctaacttaaatgtttttttccaattaaaggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttat

SEQ ID NO: 1203 - DNA, 375 bp, Homo sapiens
  Genbank Accession No. AA458852
ttagcagttaaacttttattttactgtttaaaatttttatttactttttttgtttttcttttctacaaaaggcaggtgatgattgttgatctgcaactattgtgttgtgcactccccgaaagggtcagagtaggaagccagggaaggtgctctgaggatgctttctatggagggaataagggctgcaggacactcactggagggagtgtctgggcccttctcctgtcctcctcagccttccctagctcatgtctatggtgttgaagacccattctgtgaacttcttcagcttgtccgaggcgttctgggactcctcctgtagcctcaggttgtcctctcgcaggtgctgcacctccgcctgaaggtgagctttgt

SEQ ID NO: 1204 - DNA, 369 bp, Homo sapiens
  Genbank Accession No. AA458878
ttttttttttaaagttttcagactttatttcacagcgattgacacagaaacatactagagttagtaacacggcacccagccccaccgccgcccgcttcatcgggtcctgctcctaggaggactgggctggggctgggggtggggatgggatgggggtggggaagggacgggacgttgcagtttaaggcatttctggcttcggagccatccctgccacctctgcacctgccccttgaccttggtcagacactggctggcccctggtcattctgagacaaggacgactttcactgacgctgtggggaggatttgcagtgaggcagccctcagccgctctcaggcgagatgggaaagatgagacccaccact

SEQ ID NO: 1205 - DNA, 233 bp, Homo sapiens
  Genbank Accession No. AA458882
ttttttttttttttgtttttctttactgtgtttcatttaatgctgaaatcagacaatgattagaacatgaaactttgtttgaaaaagtatattcaataaattttgtatttaaaacagagctcttgacctataaagtataaaaagtaattacaatgaaatattcttcagtaaatctgacactttgggattccaggcaaaaggatcgcttgggtgccaagagttcaagaccagcc

SEQ ID NO: 1206 - DNA, 399 bp, Homo sapiens
  Genbank Accession No. AA458890
tggtttctgctcagttctttattgattggtgtgccgttttctctggaagcctcttaagaacacagtggcacaggctgggtggagccgtccccccatggagcacaggcagacagaagtccccgccccagctgtgtggcctcaagccagccttccgctccttgaagctggtctccacacagtgctggttccgtcaccccctcccagggaagcaggtctgagcagcttgtcctggctgtgtccatgtcagagcaacggcccaagtctgggtctgcgggggaaggtgtcatggagccccctaggattcccagtcgtccttgtcctcatctacctgtggctgctgcggtggcggcagaggagggatggagtctgacacgcgggcaaaggctcctccgggcccct

SEQ ID NO: 1207 - DNA, 418 bp, Homo sapiens
  Genbank Accession No. AA458923
gacagtttaactctttattctccttcacagcccagcagaccccaaggcgggcagagggtgcaggccgtccccaggatgctggtcatgggccagggtcatccttgcacctgcggcagtaggggcagcagccatgctgaagcaccagcaactcatagtcctcagaatggaacatctggaagcaggaggggcacatggtaatggaggcgtcaggcagcagtgagcggaagtattgccacctcaggggtgggggccatcgcttgatgaggacatcccggcggctcatggagcgcacacacagccggctcaccaccactggcacgaaactctgagccaccttgctcaaagctcagcttagctgtgaacgggtcctcatctccgatggagtccttggtctccactagccgcagaatctgggagc

SEQ ID NO: 1208 - DNA, 413 bp, Homo sapiens
  Genbank Accession No. AA458934
tttttttttacaagaaaaattgttagttttattggtattacagtgtacttttaatacaagctaaatacaaacacaattcttacatattcagccacttattctgcaaaacaacatgccaagatcaaccttgaaaagtttataaaaaccaaaatccagaaaatatcttcctcaactctaaggactccatatacaaatgcaaaaattgctatttgtcaataatcacattaagtgttgagttattgactgagcagtaaaaaacaatttctgatttttaaattaaatagctccagataaaagcatgttattttccacatacgctatctttgtattctgcacagagttccaaggcaaagattgctcctggctttatgaattaccagagatgatgacttgtgtggctgacttatcacagg

SEQ ID NO: 1209 - DNA, 395 bp, Homo sapiens
  Genbank Accession No. AA458946
tttttttttttgaagttaaaggacactttatttactgacagattgaaaactgtaactccaggtagtgcaaaatgcaccacaacccaattacaaagaacaggtgttaacacacaatgtttaaacaatgctacactcatttttggcaaagtgctgtattgttcagtctgtgtacaaaactgaccatctatgaaccaatcagtataaaaaatttctataaaaacaaaatttagaccgtggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcat

SEQ ID NO: 1210 - DNA, 406 bp, Homo sapiens
  Genbank Accession No. AA459005
agattttttaaaaattttatacaaatagactaactttgatttaaagtaaacatataaaaattgagaagaatattgcttgcaacaatggacttggaaggagaggaatggattaggcaggggtacaaagaaatggctcctactcggtagttccaggcacatgcccagcactctgcagaactctcacagggacaccctctgctgcaccgtgtccttcagcccacaaagtctgactgattttgtaacaacaacttcaggtcaggaaaaaaacaaatgcaagaaaatcggaaggcacaagcacccatgtgatctagaatgttcttggggtgaggaataaggagggaaagggatacttttggttcagcactacagtcaatttcgccattgttgaagaaaaacggtataaaat

SEQ ID NO: 1211 - DNA, 398 bp, Homo sapiens
  Genbank Accession No. AA459254
ttacaaaagaaaacacaaaaccagaatttattgaaagtaggtaccagctctgattagaacaatcagctcaaagataccattactcagaacaatatatacaaaaatctcagggaaaggagaataaaagaacttaaaagaatacaacttgaacaggactgttttactaaaatggtcttgttgcaaaataataacaaataccacagagagccctacatgagaaagccatgtgccttcaagcctggggatgaggactctagttctcaaattcttagaacatagcacatgattctccaggcagagaggctggctggagaatgaggacctcactgctgactctgcttaacaaagtccatgccccaggcacaggcacacatggaatgaggccaccaagcaagtca

SEQ ID NO: 1212 - DNA, 388 bp, Homo sapiens
  Genbank Accession No. AA459256
tcatggagcaagagtaaattctgtgatgatgaagcctctgaaacatgaatttcaaaatgttaacactacaaaagaaaaatgctagagaagcattttctgtgttgaaatgactgaagtaaagtgagttatcactggcatattctctttcagtgttctaggataaatatcaacataaaaagcaacgccagactgtttgcacacacagcactcgtttggtattgctataatacagagttcttcagaaagtctttatatatagattttaggtcgttagcccaatctgtaaatgacatttgagagcaaacctagggaggcttggaataattcaacagtactattttataagatagtattgtttggaattctatggcaaatgaaagacaaccat

SEQ ID NO: 1213 - DNA, 461 bp, Homo sapiens
  Genbank Accession No. AA459293
ttaagtatcagtttttattaaaaagtgcattttgattaatttatgatctaggtaagctgtaagataccagtatactctctggaataataactttacaaagatttaaaacaaacaaaattttaaaagcctttttatttccttcaccattattgttttacaatacaaatatcaccttgtgaatacacaaaaaaatcctacggaagataattctgctgcacgtaaaatacagaatggatatatatacttcttcattcttaaaaaactattttgttctccacattggcaagtatagaatagaatacttccccaaacatatgtatgttaggagtaaaacttagagttacatgcagtttctgcacaaatatcttttaaagaaatagatctcttttttgttgttcaccaacaaaattgtcatgagagtatggataactaattcatagctttcaagttttaggtaagtg

SEQ ID NO: 1214 - DNA, 350 bp, Homo sapiens
  Genbank Accession No. AA459310
tttttttttttttttttagtcttctctaattttattacagggcatgttggggacacgggagggaagtgttagaggagtgacagggcagcccggggccctctcccaccctgagcctcgaggcctggcgggggacatgaactgcagaggcatcagataaggcctcagaaagcccaggccatcattttccatgggaccaggctggctcaatgtggaactggccctcccagagcagcaggagaagggctcgcatgggctgcccccgtcacctgtgcctgacaggatggcggggaggcagagagagagcatcagacgccctccctccccataaggggcatgggggatggggacac

SEQ ID NO: 1215 - DNA, 170 bp, Homo sapiens
  Genbank Accession No. AA459388
tttggtcttcactggtctttattgaatgagggttgtcaggagcaaaggtgggatcaagagcagcaaaagcagaaacaagtataaaagtatcaaaaattcaaagtgctacaatgaggaaagtgagaagggttgggttgtggcccagagggacctctgggacacaggattga

SEQ ID NO: 1216 - DNA, 309 bp, Homo sapiens
  Genbank Accession No. AA459389
gtaaagtgaggcacaaacaaatgagcctctgttcactttattcaaagagtatttttttcctctgtgaaactaggtagaactgaggaggaatcaaagaaagcctcatatattaaactcttaaatagattctttgaattcaaagtaagggtcaataggagaggcacaggttgtgggccttgtcccagcaaacaaagccaccaaggcagtcctgcaaattaaggaggatggcaaatctgtctcttaaaaaaaagttcttgaggggaaaaatataaaatacctaagtttcaaaagccggactacttccatacc

SEQ ID NO: 1217 - DNA, 261 bp, Homo sapiens
  Genbank Accession No. AA459420
ggaggaactgatgaattcattttaatcacagaaatttgcctgggcttgagcaaactgtggggactcaatagatttggaggcctcctctcccttctgagaggcctgcctgcttcctgccctgatgaatccctaatttcagtacaaactgaggaacttgaaaaacatctgtgcactgggaccgcccctcacaggagggctgaaagagcacagctgagtcagcggcacattcagcaggcgttcagtggggaagcaggagacaga

SEQ ID NO: 1218 - DNA, 424 bp, Homo sapiens
  Genbank Accession No. AA459542
cagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatg

SEQ ID NO: 1219 - DNA, 306 bp, Homo sapiens
  Genbank Accession No. AA459668
caattttcagggtctttattttttatattgtatacctaagttgatttcatcaacatacaagccaaacgaagatcccatttcaattagatataccactcaagagaatctccaaagatcttcacatttttccatcttctaaaacaaggattgacaaacttttttctgacaaaaaccagacagtaaataattaggctttgtaggctttaccatctctattgcaactactcatttcaaagcagccacagataatatataaacagatgagtatagctagttccaataaagctttatttgtgaattctgata

SEQ ID NO: 1220 - DNA, 303 bp, Homo sapiens
  Genbank Accession No. AA459673
atagagaatattttattagactttacaaatgacaactgcataaaacagaaaccagtttcatgatatagtttagggagtatgtattttatacaactcataatcctttacaaatagaaaaaaatcagtaatacactgaatcaacttgaagaatcttcagcataaagttcaacaaagtcccttagatgcaatttcttttggatttacagcaacactttttgttatgttgtatgtcttgtaaattccaataagtctatccgaaatctcaaacatattatttcgaagagaaattattatgaactgtgc

SEQ ID NO: 1221 - DNA, 302 bp, Homo sapiens
  Genbank Accession No. AA459690
caaatatttaaatcatttattgccattaagttacagcatctcaatatatacactgcatggaaatacacaggtaacatttttaaacagtggggacaaaattttaagtacgtggccagctgttggttgtcttgtggtcattaaagacaatgttaagaatcaggagtacttaagtgctagtggttacaaattttgttctcttcagtttttcattaagtaaattctaatagatgatatacatattactgcagataaaaccatcatcagaaattattaaattaattgcatattttgagctactcttt

SEQ ID NO: 1222 - DNA, 298 bp, Homo sapiens
  Genbank Accession No. AA459703
gactattaacattttattgttatacagcttaatggtggaagataagactgtggtcaatccatatagaaaattaagaagaccatgttttagaatattttgcagggctttttttttttttgaagtcccctctttttttttccttcagtgtggtccttaagcatcaatgtttggtggttgtttctagcaagtcttttgcttcatttattttggctgctacgtaaggagatccacctttatctgggtgattcaaaatcatgactctcctatgagctgttctaatcttagccttgccagcaga

SEQ ID NO: 1223 - DNA, 469 bp, Homo sapiens
  Genbank Accession No. AA459961
ttttgtggtccaaaggacagtttatttaaaacaaacgtgatgaggtataggaagaagaaaagaaggagaacaacaattctaacataaaaacacaggaagcatctcaaacttaaaaaagaaaaaaggagtgggggcaatggaggaagctatgtctcatacaaactgctgacctcaattgattacttacatccaaaccttacaaaatagcatttcaagtcagcacttaagccagtgttattagattttcttacaaaaagttaaagctacaaacttcacatttttaaactgtacatagcaacaacatttaagcttttttttttccaagttggtccgagtgcaagctggtaaaagagattttttttccaaacacaaacaagaacatgtattccaaagacaatgaatataatactgataaaaacacaaacatagtgcttaagaaaagatggggtgaggtggagatgtagattgg

SEQ ID NO: 1224 - DNA, 283 bp, Homo sapiens
  Genbank Accession No. AA460012
tttacgatttaaaattttaattgttaccaaacaaaaatatccactcaaaatacaattcaacaatgcaacagtcatcttacagcagagaaatgcagagaaaagcaaaactgcaagtgactgtgaataaagggtgaatgtagtctcaaatcctcaaagagttgtgtttatttcatcgacaaatagattattcgtattcaattctgatgtgttttaaagactaagatgctcattttacgattagcgcacatgtgtatattgtcacctgttctccttagaaaaatgc

SEQ ID NO: 1225 - DNA, 282 bp, Homo sapiens
  Genbank Accession No. AA460017
tttaacaaaacacttttatttggtccactggagcctgagtcggaaaccactgtggagaatcctatcataaaggaatggggactgacagttgataaaacagcttctgtgtcacaagagctggccgtatttacatatttaggggttaaaaatattcacagttcagggtacagggaggccaaaggggagtggggaatgtttctccaggtgtaaaagctctggaagcccctaggagggtacgggtggtggtggtggtggggggggtggttgggaggggagtgaagg

SEQ ID NO: 1226 - DNA, 496 bp, Homo sapiens
  Genbank Accession No. AA460047
taccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttat

SEQ ID NO: 1227 - DNA, 531 bp, Homo sapiens
  Genbank Accession No. AA460128
ggcgtttcttcagtgatgttaacaagagcttgtcacagtgggaaaaatacggcattgttttcaaggaattcttttttaaagagacttctatgagaatggatgcccttgtttctcgttgcaggaacaagcacatcatgattgacttggggactggcaacaacaacaagattaactgggccatggaggacaagcaggagatggtggacatcatcgagacggtgtaccgcggggcccgcaaaggccgcgcctgggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagtta

SEQ ID NO: 1228 - DNA, 301 bp, Homo sapiens
  Genbank Accession No. AA460449
ttttttttagatgttttaggactttaatgttctttacatattcaacataaaatactgacaatagataaacaataggggaaagacttttcagcaaagtatcgctctcgtagtcatacattacaaagaaaacagtagagaacaaaggatagggtaatttaacagaaatgtttagtttaatggcataattgaaaaacaaccaaccaatcaactttctcttctacctatggaaagaatggtaaaaatgaatcaagaacttctaggtctttttcataaaacagcttaaaaagaggaaggcgaagac

SEQ ID NO: 1229 - DNA, 427 bp, Homo sapiens
  Genbank Accession No. AA460661
ttttttagagaggacatttttaatacacatttgaaaaacatcattcaaagcctacaatttactatttgtgaccagtaaacagtgtgatcattatcatcagaaagtataagatacagggcaagggctttgcttccaacactgaaatgaagggctacgttcactccaccattgagagttctttgttttttgtttttcttgttttttttcccaaggacaaagatttgagttttcaagtagcaatgtctgttctcaaaggacaaccaaagtgctgctcgtcacccacttccgtgatctcaagtccttgtggccatcactgacctcagctagatcaggccagaagtgtctataatacaaccacgtgtatttcaccatgcctccaattcccattagaagctttttcctgatatactctgaagactggctattg

SEQ ID NO: 1230 - DNA, 293 bp, Homo sapiens
  Genbank Accession No. AA460665
ttttttttttttttttttttgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtacgaggaaccgggcttggcttcctattgtgactgatgagaaaagtgaccacgtgggggtcagtcgggggcaaggggctcagc

SEQ ID NO: 1231 - DNA, 450 bp, Homo sapiens
  Genbank Accession No. AA460666
ttgtggcagaaacattttaattgtaaacagcaaggctctctgccaggcagcccagatgaacaggggtggcactgtgctggggtgaggtgctttctttgtgggaacgaaagcagacggcccaccctcgtctagccctgggcccctgtccccaaggccagctcgctgagcctgcgctcctcctggaagcggatgagggcatctctctggttgaccaaatccaccagcttcctcaggacctggtcctcagcctgccgatcagcagctgtctttaggttttcttcccggttcatgtagcctcgtagctcctggtccagctgccactgtttctcctccagattcaattcctgcaccgtgatcatgagctcggcctcctcagccaccaggtggtttttcttgtcaacgagctgtagcagctgtcctacccatagtttcttttgctgttctggggaa

SEQ ID NO: 1232 - DNA, 350 bp, Homo sapiens
  Genbank Accession No. AA460909
tttttttttttttccattgcctcagttttaaatatttatttaaaatccagaggggaaaaggagaaacggaacccattggggttttaatacactgacatgtggacagagacgtaaacgaagacagcaggaaaacccaagaatgagacagaggccagtggattctggcagcaggagggatccgagcgctgagatgaggcccgagctgctacaaacacgcacttccacgcagagctccaggctggggcggcagggcgaggatacagaagtgttgggaggggggacgggccaaagtgaggtattaaataataaaaatcaaatccaattcccaaagagacacaactttaggagag

SEQ ID NO: 1233 - DNA, 417 bp, Homo sapiens
  Genbank Accession No. AA460916
ttttttttttttttttttcaaatattcagggaactttatttttaaagaataaatcaagtaagacacagctttcgtttacctaaacatgcataatccaacctgaatataaactgcacttaattggtgaattacacatgaaatacaaagggaatgcaattttacatatgtaaaatgattgctagctatagcaatttaacagtcaaatttatcagaacattgtacattaaaaaacacaaacaacaacttaaagccaaatatctatagtaaaccaaggaaaattctgatatggaatggtttgactaaaagcaaagaataaggcacctgctatgaatttagcacaaccataaaacagaattagttaaccaagacacttgtttcaaaaagggaaacaagtacagagactgattaactgggtga

SEQ ID NO: 1234 - DNA, 336 bp, Homo sapiens
  Genbank Accession No. AA461057
tttttttttttttttttttgattaaaccagtatttattaacagcatgcctgattctgtggaaagcagacttgaaccctggtcattcctactctcaggggcagcatgttaaggatagcagcctgcaagtctatctcttaaactccacttgtgtgtacaccttggtgatgtcattgtacctgccttcagggggttggtagttagggatcggtggtgtgtaatgtggcccttccttctcaaaggggaacaggttaggatcccgcttgatggcctcagcatggagcttcggggattccagttgcagttcctccagagcttcctgctgggcttctagcata

SEQ ID NO: 1235 - DNA, 473 bp, Homo sapiens
  Genbank Accession No. AA461063
tttttttttttttttttttttttttttttgtgatgaaacttagaaaaatttctttttccataacataaacatgtcagtttttccctttagatccttcttccactcccgcttcactgtgctgaagagatattgagttcttccagatttttgcttagctgggtggtttccgaactcaacggactctccaggtaggtagttccagcacagggctttcctgtcactggatctatgacttttccaactttgaaaacgatctcagccagttcatgtttcacatgctttgctcgtggaacaggtaaagctctgagaagcacaatatccccaactgtgcactgctgaagggcatcgtgagcaaagtaggttttccgcttattaaaatactttaataaatagggatccagaacaagcctggtcactctcactttagcagtcttttgcatttttgtcccaatcacctttcccacaatccatcg

SEQ ID NO: 1236 - DNA, 465 bp, Homo sapiens
  Genbank Accession No. AA461187
ttttttttttttttagaaatatatattccactttattagttagaaaaaatcatttaagccacatggtgcgcacaatgtccataacttgagcaggctttggcatcccaccacccccttcagaccaatacacactatgttggaggaacgactttaaaatgtaaaatgagaaatgggcactgaacactccatcctcactcccaacagcccacccacacaacctcttcaactgctatccaaacatggaggagctcttgtggaagagaggctcaacaccaaataattgagcataagacattcaagactaaaggaaccccagacagatgtttaggaagtagggttgaaaatatcaccatctcccaacagctgaagttgggacatctaagagatgtcagagccatactgctgaggaaagcacagcatacaccagaccccggggtaagggcgagatcaacctatctcatagcc

SEQ ID NO: 1237 - DNA, 487 bp, Homo sapiens
  Genbank Accession No. AA461282
gcaaggagagggggtggggttcgcggaaggttctggaggggtcttggtaggtcagcagtgaaccgtcctgaggatggagtggggtcccatggtgcaggtctctgaacaaggcggaggtgtggaggagaggccggcttggggtggggcctcgcgccgtagtgccggccggctcagcccggctctgcctggtgctccctgcagtgccttctccacggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggcaaaccagtcactcggggaggaatgcggaggagcgctcattccattctatttaattgcagtgtacaaaattgtgtttgtatatagaataaactgtctgttgacagcgaaaaaaaaaaaaa

SEQ ID NO: 1238 - DNA, 366 bp, Homo sapiens
  Genbank Accession No. AA461303
ttttttttttttttttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtga

SEQ ID NO: 1239 - DNA, 311 bp, Homo sapiens
  Genbank Accession No. AA461444
ttttttttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgca

SEQ ID NO: 1240 - DNA, 517 bp, Homo sapiens
  Genbank Accession No. AA461448
ttttttttgcttttcaaatctgcttcagtttattatatttgtttctgtaagtttataacatcttttctaaacagacactaacggatctcttttttttcttcctttcttagccaggctaatcctaaaagggctctgctaaaggagatcactggaatttcccagatccctgccctaagcgtggagggtccttctcaaacactcttccatacagggccataactaagacaggcaaaggggctccacttcggctcctcaagcgtccatctcttgaaatctcataatgtctttcaggggcaagctgactcccacttagaatgatctgtgggaaaacataacgcgttccaaatgtgccactgagggagaagtcttcaaacttggtaaaagctgaccccacaggttctccacacgtttccaggtcagtggtttgacacttcagtaatgcacatatctgtaagtaatattggccttctactgtgtgcagtccatccaaagcacctagggcatagatctcgtctgt

SEQ ID NO: 1241 - DNA, 264 bp, Homo sapiens
  Genbank Accession No. AA461458
tttttttttttcattacttactcagttttatttaggtggacacaacagtgaagaactcaaacatggtttgacctttatctacagacacagcagcctggattttcagcctttcattccttttaaatgaaagtcagcaggctcaaaatgcagagcttggctaagtcacttctgtggaaatatgaaatatagtagtgataaccaccaagggctttcaaattcttgtgttcttctaaggatcctttcctaacaccatgatttgttctc

SEQ ID NO: 1242 - DNA, 455 bp, Homo sapiens
  Genbank Accession No. AA461473
tttttttttaccattttttttatatcctgcatttatttaagcaaaccaaatgtgtagagataggaaattaatgtgttataatgttttacaaatacagagagaaaacacagaatattaagaccctgaagagagtgcatttgagaacgcagttctatcataggagaccacttgcagggaacacattaaagccattgctgacacagccatctgtcattcctggtttgccgtcatttaagtagtttcaatagataaatcggtgatttgcttttaaacaaatattaatgttaatgattagggtagccttgaagggtttgtgagtgactgtactatacaatgtgatgctaggcttaatgtgtcatttcaatgctgttgtacattatgcaggggaaataatgtcttattacacattaactgcgacatccactaaaatgtgaactagtttgcataggttagtc

SEQ ID NO: 1243 - DNA, 541 bp, Homo sapiens
  Genbank Accession No. AA461476
tttttttttttttttttttttttttttggggcagctaaaatttttattctgttgtcaaggggcaagatgccagcttggaagtgccaaggagctaaagggcccagcactgccggccccagaactgtctgttcaggctgtgcagtaagcaccagagcctcgcctgtccacgaagggtgtaagcctgtgctccacaatgtgctcagctccagagaggcccaacaacctcaggagggcttggctgtgggtctgaatttctttcctttgtgcttgaagctgcgcagtgggttctgggactttgctctcttggccttcctacaagaggaagacagcttcttccgcttttgtgagggcgtaccaggccacggagagcaggaggaaccaggtagtcaggaacatggcccaggtggggcttcaccactgcggggtgcaaaggtaggtcatgccgcagcagctggaggtccctagggttgtcttcaaagtatgtcttaagcttctcagaatgcagaagctcttccttgatctccttcaatcttgcctcccg

SEQ ID NO: 1244 - DNA, 355 bp, Homo sapiens
  Genbank Accession No. AA463194
agaacaaaatggttttaatcaattgcgtcaccctcactctcctgggagcggcaacgaaaaaggctcggctcctgcccccagaggacagtaaggcttatgtgtctctccacactgcagggcccaggctggcgaggcagggggtgggaagcaggacagggggcagggagggagggtgggaggcagggaggaaatggcaggtggctggaacacaagaaagcaaaggggacccagctggtccttgggccccagggcacgcccctaatactcctgctctcccttcaccctggctagagaaaggtcacggagaagagacaggggagcaggtcccagcagcaggagaagcagcagcagctgt

SEQ ID NO: 1245 - DNA, 362 bp, Homo sapiens
  Genbank Accession No. AA463195
cattttgtgatcaaatttattttttgtttaaatttcatttactttgttttactgtaatttacacaagagactggcaagtaaactaggtattttacattcaccacacattccctcaaatctccacagttgttagaaaaacattaaaatccatgcgccgggctctcatttccatgtgcgcctaagctcccaatgatactacagatgccagcgagagttaagttcattaaaaggagagggctagactctttatttcacaaaattagcaataatcttcctcgcaccaaacactttgcagacaatgattatgctctgacaaaacctatcttacaacagtgcccagagagtaaacatcagtctttatc

SEQ ID NO: 1246 - DNA, 332 bp, Homo sapiens
  Genbank Accession No. AA463234
ttttgatgataaacgactttactctaaaagcggctggaactcagtgacatgagcgtgcgctgaccccacatgggccccctgtgcaagcagagctggccggcccctccttgctggcagaggcacgggaggcctgctggggatgaggccactggccagggctatgctgcaccagaccaatggcaccgccccacccctcccagcgcaggggcagcttggagcagaggcagcactggccaccgctgcgggggcaagtcagcgtcaagagagtccctgagtgagaaggcccagataagcccaggccccccaggccagcggacaggcacaggcagggc

SEQ ID NO: 1247 - DNA, 239 bp, Homo sapiens
  Genbank Accession No. AA463254
aagctagaaaaaggccaaaaagcaaaacctgagaaaacaatacgtgttgttttctcaggaaaagaaaaaccttcatgaccctactgaagagcattggagatcagcttccgctaagatgctagcttggccaagtctgttatgttcacctgaaaaagtcttagcagagaatttttgcattcccacccaaaagccctctcagccactcaaatgcctatcttctccagtctacaagttacatg

SEQ ID NO: 1248 - DNA, 420 bp, Homo sapiens
  Genbank Accession No. AA463311
caccagatgaccacggcagggccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggt

SEQ ID NO: 1249 - DNA, 331 bp, Homo sapiens
  Genbank Accession No. AA463725
ggggtcatatttttgttcactgaaaggaccaaccagtttcatcaaacaagctttagagaaagagaaactgagtaattcatcttgtcagttacagttcacatatatgcacacacatacaaactggctcagcatcagtgaaacataactattcaaatacaaaagtataaaaaacctctttaaaaaaccaatagcagccaaaacagaacatttgtaaacaaaaccacaactatcagccctgtgcttaaacacagaatctgcattcttttgaaacattaagtatatgcaataaagagaatatagaccatctttttccttaatatacaatacccaa

SEQ ID NO: 1250 - DNA, 252 bp, Homo sapiens
  Genbank Accession No. AA463729
aaaaaagattacaaaactgaatttattgagattcacacaagatgcacttataaaattagtactgaatgccattaaaacagaagaaatgaacataatcccgaactcccaacagcatctgcaaaggaatggaaatcttctgaaaatgacagcgcagtaacagaataattcaagcggaactgaagatctatccaaaccatgttcctgctctgaaatcagggttgtgtttggcaaagctttccccaaactattcca

SEQ ID NO: 1251 - DNA, 534 bp, Homo sapiens
  Genbank Accession No. AA463861
attgatataaaacagctttatttgagggtcctagtctgtgaggggtggacagataaaagaggtatttgtgatagggcatgaagaccttaagaccctgagggtgctgtgaacagggaacagtctgatatctggaaccaaagggcaaggaaaggtcctggggctgaagtggggacaaggggcaccaaaaagccagtgggggcaggtggtgctggccaaggtcagaggcggatgcaacaggccctcttctccccagggccaggctcctgtccagcctgggcactgccagagggtgatggcattggtccggatgctgttctgtctctgcttggacaccttcgcaaagatttctttcaggacagtctcaaaggctagctgcaacattggtagagtccagggctgaggtctccaggaagagcagtccattgttttcagcgaacattcgggcctcctcagtgggcacttcccgggcctggctgaggtcacttttgttaccccgagcatgacgacgatcgtggcttcagcatggtcatagag

SEQ ID NO: 1252 - DNA, 489 bp, Homo sapiens
  Genbank Accession No. AA463876
tgcttccaactgttttattgctaaactatcatgatacaagccgtataaaaatactttacatataggaaaaataaactacattaaactggagattaaaaacatttgcataggaatgtgatgtattcaaacgcctttaacagtcaggattttctaaacctaagcctgccagcaccaccatgttggagagacctgtttgttggagaattggttttctctcctctgagggctgtagaggccagaggggtgagtgaggttctttgacaagatgtccaggatgctaagcttgtcccaacagccatagcctcggtctgctcaggccaatcagaatgctgtgagcacctgctctaatggaaacaacatcatttgcatccattccattcaaagcttgaactcagcagggagtttattctggtcagccaacagctgcataaaggtagaatgttaataacccttcacttccagctcccaggaccctgatggctcagggag

SEQ ID NO: 1253 - DNA, 335 bp, Homo sapiens
  Genbank Accession No. AA463934
aaacaaggagtttagttttattttctctgtgcatttgcaaaatactcaggaccaacataaaaaagaaatacctcctgtggaaaaagttacattaaaaaggggaatggagtgggggtgctgaaagggattagtacctttgccccaaggagctacagcatctctgattggtccaaggaatagaaaagatattgggaaaatgtaacaggaggaaggaaaatgtgaatttactgagggagagggcctcgaagtgggcctcgagggggaactggtggccggggagtgggtctgggtggagggagaggcccccgctggtagccatagggtgggggtcgtgg

SEQ ID NO: 1254 - DNA, 270 bp, Homo sapiens
  Genbank Accession No. AA463946
ctttacattttcccagatcatctttacttaaagattttttgggagaaaaaggtaggcagcaaacatttttatattaaaacaaatgcagatagtaatattgaaatagtatataaaattgacattactttttgagacaaaggaagagacatcaaagacattttaagccgagctcctcatgagcttcctaaaccccaggggagggaagagacccctgcattctcgttctgtctaatattatcagtggggctgttttgacagagaagtctcaga

SEQ ID NO: 1255 - DNA, 260 bp, Homo sapiens
  Genbank Accession No. AA464043
cggcactcccctcacacctcccaagatgaagctcaatgaaacttccttttgaacaacgcagctgccatgatgccttgggatgccctggtccccggggactcaggtgcctccctgattcctgtgggaaccccgggttcagggccagggctccttggaataaatggttattgttactaggtccccaccttccctcttttctggaagccaaagtcagcctccccaataaagtcctcactgccaaaaaaaaaaaaaaaaaaacc

SEQ ID NO: 1256 - DNA, 367 bp, Homo sapiens
  Genbank Accession No. AA464188
ctgaggttgcttttattccaagacctctgtgagctccgcccagataccattggcgcctgcttgtgtccccaggggacctacacacaacagcaccagcaccatgagggcgctctcgacccacacaagccctggtccccgtcagtcaatgtgactgagtccgccattgaggccagtctggctggccccaagtggtccctctgagtccccaactccctggccagcaaggagtgaagctccatgccccttggtccacgcctctagagtctgagcatatcctgcagcctcgatctcaggaggcaacgcatgcagcccccctgcactcagaaagggggcttctccagtcgtggtcttcttctctgtccacaag

SEQ ID NO: 1257 - DNA, 323 bp, Homo sapiens
  Genbank Accession No. AA464251
tttttttaaagctttttattatagacattttcaaacatatacaacagtaaaatgaataatataatgagccctcacacctccatccctagtaactgattatccgtgtgtggcttactctttgatcgatactctcctgctttcccctagcccccacagttagactgtcccgcagcaaagcccagacagacatcctatcggtctgagaattccttatcaaaagcttcccgaagaggaactctatatagggcaggactaagtgtgctggctataggtctgcagaaatctcaacccttgggagcccttgggtggggcctgggcaggtc

SEQ ID NO: 1258 - DNA, 91 bp, Homo sapiens
  Genbank Accession No. AA464414
taagatgaataaattgaagacatttatttcctccaagaaaaatgtctggcacttggaattttcaagctgcaagtagatgtacacattttca

SEQ ID NO: 1259 - DNA, 407 bp, Homo sapiens
  Genbank Accession No. AA464423
tttttttcagaaattgaaaaagatgtattaaaatattcacaaaaatacaactgaagatcaaaaaataataatgagcttgatggtttttccctagctgatatatttccattgaaaaactagagatagtttgaaatttcaatctctaagtaatgccttttgagtgctcccatacagaattagcgcataattttaagacgaccctgtttgccaggacgaagacatggagagggcagatctgctcttaggcaaccttagttcgttatctgcaaccaggaaaggagtgctgaggcacagggaaaaggggagccaaaagggctgcaggggtgggtgtgcagggcatgggaagaggtcctgccctgagaggctcatctcagtgtgagcagcttccttcagggaaacctgtcctg

SEQ ID NO: 1260 - DNA, 350 bp, Homo sapiens
  Genbank Accession No. AA464603
ggattgtgatgtaatctttatttcttactctgagctccagttagaaaagtttgacaatcattgttatagagctatgttcacacagtggagactttctgactcactgtgagctctgctgtatctatgcgctccccggagagggacaacttgctaaggtacagtcctgtccattggcatggatatttactgttccacatgttgggaaaaccatgtgcaataaaaatcaaacatatgaaacaatggctgtcattgtaccacagtatacattgtatcttggtgaaggttcttaaattactccttggagtttcctaattcacttcaggaaggatttgttgtgttccgtctttatg

SEQ ID NO: 1261 - DNA, 337 bp, Homo sapiens
  Genbank Accession No. AA464606
tatccaaccatttataatctttattctataattctccgccagtgctagaattttcttcccaaatggcctcaattcggacactgaataaacgataatgaattttttaaagctgtgcttaaatataaacaaaataaaccgctaagtttttctggctccaagcacgccatatgaagcacgccaatgtcacttatgtgccctgatcacattcaggcaaagtgttcttcactttaaatactcctgtgttccattattgtttaagtaaaatcctatttcaaatgcctttgataacagagaaaccgcctgtagacaaactctttgaaagtgactgaattaatgt

SEQ ID NO: 1262 - DNA, 379 bp, Homo sapiens
  Genbank Accession No. AA464698
cacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagttggagggagggagggccaaaaagaaaagggagaggaggaagaaaaataacttaaataaacacacacacaaagaaaagagaaggcaacatgacgtgagctggtgatccatgaaggcagggagggaggggaaccgttttacctgtgctgaac

SEQ ID NO: 1263 - DNA, 209 bp, Homo sapiens
  Genbank Accession No. AA464722
gcagttccagacttcaatcaacattttaattaccaagtctatatttagcaagacaatgtgggagagataaagaggaaggaaggggtaggtggggaggggttctcaaaggagctgacccattttctgcattggctgcagagccttgcagtcctggccaggagttcttggccttgtgcatttcagaagtgccgacacagtcaaggaggtac

SEQ ID NO: 1264 - DNA, 406 bp, Homo sapiens
  Genbank Accession No. AA464962
gtttttacctgctttacttccaaaaagaacacaaggcatagctctctttttcaattaaacagaaaactacataattacgttcaaacactcactgaagagcctgcctcatgggaagggcagggctgtcgtgggaagagtcagctgcactttggcaccatctcaggtgcctgtccaagccggatctgaatgggactggtcaagtgaggggtcagtcctgcagtctgcgctcacacctcttctccagatctgccatctcctttaggaccagggccacgctgtaccgcagctcctggaacttggctgtggggacctcaaagcggtatgctgacccatctgaaagcttcagctgcatcaggacgctcggctgcagggagcgagccagggcactggtggagattgctacatc

SEQ ID NO: 1265 - DNA, 454 bp, Homo sapiens
  Genbank Accession No. AA464963
actttgtgtgttgtgtcttattaacaccaaaatgtgccacatcatggtttagaagaggtggagggtgcaggcaggaggctccgaagtcccaggcaggcgcgcagcctctggcatctccatggactccagctggagagcctgtccgctcagcaacaccccaggcagcaccaagaataacatgcccacaagaacatcatggccaagagacgcacaggcgcatcccgcttccaggcacctttcccacctggccagaagtccctgctgtcatcccgacttgcacggtggttttggtaaccagtgggctgtgcaggagtgaaagtggggtcactttccttcctttcccagctgctggagtcggaactgctgcctttgtttggcggccttgtttcttaaatcagttccctcttaggatttattacactaaaaaaaaaattagtttttgaaaagaaatagg

SEQ ID NO: 1266 - DNA, 236 bp, Homo sapiens
  Genbank Accession No. AA465000
caaggctttgaaccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttaaaaaaaaaaaaaaaaaaacc

SEQ ID NO: 1267 - DNA, 302 bp, Homo sapiens
  Genbank Accession No. AA465093
gcacaggaaataattttttttaataagagaacaatgagggtcctaaagtagaaacataagccagaagaaatctaaaaatagcttcctgatattttattttaaaatatttcatttaagctgcttttggttgcatgccctgatctgtagaagttaacaaggaaataaaatttccaagtatttaaaaaatttactcatcttccataaagcgacttttaatgtatcaacacttaaaaatacacagtgacttaatgaagtatcagcacaactgcatagaattgagctccagagaattatacactcga

SEQ ID NO: 1268 - DNA, 400 bp, Homo sapiens
  Genbank Accession No. AA465218
tttttttttttttttgatgaggaagacaaactttataggaagctgcaaaagaaatgagcagacgggatatttgtggtaagggatacaaagaacatacaattgtgtacttgagaggtttcatggaacattatgacccatccaatgaagacatcaacattaacaacaaaaattaattgaggaagagcagtatgaaaatattctaatgcagtgctgtccaacagaactttctgtggtgatggaaatgttccatatctttgtgctaatacagaatctaccagccacatgaatactcaaaatgtggctaatgcaattgaagaaatgaatttttcatacaatttactttaaatttaaatagtcatatgtgactagtggctcctgaatgaacaatgcagttctaatg

SEQ ID NO: 1269 - DNA, 282 bp, Homo sapiens
  Genbank Accession No. AA465233
ttttttttttttacagcttacaaaacataattttatttaaatttgtatagataaaaaatctaccaaaatttaaacaaaaattttatccaaatcctttcccacaacaaaattggacatcatggaaaaaaaaaaaaacacattcaaataaggttcccatctttctaccataaactggtagattctgggaggatgaggagtaagagagaaacgaggagagaagatagtgatactaaacacaatttgatcttcagtgttgtctcatcttgaaatagcttaataaca

SEQ ID NO: 1270 - DNA, 428 bp, Homo sapiens
  Genbank Accession No. AA465240
ttcacaaaaaccagggttctaaattattttttctcagtgtccttcgtgatcatgatgacttatttgtcaacaaactaaaatatacatcattttcttgctattataaaatctcttattattcacagatatataacgggagatttggatgaaataattacaaacttttttccccttaaaaaacaaacaagccaaacaaaacacaaacaaaacaaaaaccccaaaaccaaaacacaagacctttctgacgacagtaaacacaggggctgctggcttcctccccgccatcctccgcgcctgctgggccgcagtcgcaaagtgctgggtgtaccccgacacggaggccccagggtgctctctccaaggctgactcttcgcttcccctgccctgcctccacctcccctcatttcccaagcctttgtcgagggcc

SEQ ID NO: 1271 - DNA, 394 bp, Homo sapiens
  Genbank Accession No. AA465342
ttttttttttttttttttttgtttgctggataattttttaataaagtgaggtttacatcactgatatttaataatggctatatgcacaaaagaaaacacacctttttggttaaggggtgaggaagttagagaaagcatgagaaacagggagcatgtggggtgaggcggggcaggagtggaaggctgcaggacccccagctcactccctgcctgcggacacccatgacactacagatcaaggggttatgaatgacatggattcagatttctttcattctagacttcaacctagccttaaccttttgtttcagcaccagtctaacagagcagcgcaggcgtttctcatccagcagcaatgctacttcctcacccagggcaggtgcatgggctgacc

SEQ ID NO: 1272 - DNA, 390 bp, Homo sapiens
  Genbank Accession No. AA465381
tttttttttttttttaaagtcccagaacattaggatttattccttgattagttcaaatgatttcaacagctgaattccttgagatgtgtaaggcaggttggtcctttggatggactgtagactgaaacttcctataactgtagtgatatgtacacagctacatagcaaagtgcttcattatgaaaatgaagaaaacaggtatgagaaaaatatattttagagtttcaaagaactcaaactgttatttttcagactaggcactgaaacattttttctacaaaaacttgccagagattgtctcttcgctgtatagttccattatcaagctgggctacagacaacagacagctaactagctccatcctcctgagaaacactgtgcatagaaat

SEQ ID NO: 1273 - DNA, 407 bp, Homo sapiens
  Genbank Accession No. AA465660
tttaacttacatttttaataatattatttttaaaaaaacttggagctgggataagtggcagcagggaggaggggcccagagctttacccctctattaccagctgcctaggggaaggagcattcaacgaagccccgtaactttaagtccctaagggctgtgggtatagacaaccccaggcttgaaaggggtaaagtcagggggatgggaaacccacaatctggggtgaagatggaggcaaatgccctggggggtggtcaggacatgtctcagaggcccaggttccaagtaggcatccacatgagtaccccctccccctaaaaggctctgtagaggccaggcccagcccagggccactgggggggcaaatcttggcacctgcccccagagagtccagttcctccctgaa

SEQ ID NO: 1274 - DNA, 299 bp, Homo sapiens
  Genbank Accession No. AA465720
ctggttgatgtattatttattatgtaacagttctgagaaaaaatccaattcaaaacatattactgaggattctgtattagtatattttagaaatcgtataatccaaagctgattttctaatatattttcttatataacacttaaggaatttttcactcccattatttggctctagaaaatcttatgggaaacatttgttacactagaaaacaaaatttaagtacagttgttaggcacggttaaaagggatgatacacacaaactataataattacaaatcagtacttctttttgaatac

SEQ ID NO: 1275 - DNA, 522 bp, Homo sapiens
  Genbank Accession No. AA470153
tttatgcaagaacaaatttaataataagctgtatctataattccagactttttttccctgcaaaacctgggaaacaagagggatgaaggaatataaacatcctaaaagcctcatattgttgaaggagactttgaaattcttggcgttgatagatacatgctcagatatttattaaacatttacagataccaaccagcaaaataaaaagggaattggaacttctgtacctcccttttcttttatcatgtgggaaagtctcaaagccctggcactgggagctgctcagaaggcaagggccacatgtgcccccagcttccccccacccccagcacagggccaggaagccactgctggtggctccctgtctgctgcctcccgagcagtaggtcccagcgaggtggggtggtaataggttgggctgggagcagattagcaaaccctctcctccccgcaaggaaataaccaggccagataagactagccataaaacaaaacaagggctgatgtagaaaaggattggat

SEQ ID NO: 1276 - DNA, 410 bp, Homo sapiens
  Genbank Accession No. AA470156
ttttttaagctttgcttttcttcatttggcttgcgtcagaaacacaaggctcggcacagcgaaggcttgcacccgcctcccgggacccctcaggccgccacctctgctgccaggcagtccaggtcctcagcttcccggggcccttgttccgtgaactctgtgctcagctgccacaccttcactgtgccctgggcatcgtcgcatgccaagagctgagtctgctggctgttgaactccagacagtagacagggctttcatcctgggtttgcttgatcaaaactgtgggtttctgggagcttttctggagatcaaacagctgcacgtcacctttcccagaggcagctgcaaaaaccaagggccgcactggggaccagcgcacagcaaacagatacttgagggagagctgcag

SEQ ID NO: 1277 - DNA, 427 bp, Homo sapiens
  Genbank Accession No. AA471278
gcgagtgttctgagggaagcaaggaggcggcggcggcccaagcgagtggcgagtagtgaaacgttgcttctgaggggagcccaagatgacccgttctaacgagttcaagctgaaccagccacccgaggatggcatctcctccgtgaagttcagccccaacacctcccagttcctgcttgtctcctcctgggacacgtgccgtgcgtctctacgatgtgccggccaactccatgcggctcaagtaccagcacaccggcgccgtcctggactgcgccttctacgatccaacgcatgcctgagtggaggactagatcatcaattgaaaatgcatgatttgaacactgatcagaaaatcttgttgggacccacgatgcccctatcagatgtgttgaatactgtccagagtgaatgtgatggtcactgaggt

SEQ ID NO: 1278 - DNA, 436 bp, Homo sapiens
  Genbank Accession No. AA471384
ggtaagaagaggccgctcttcctggggttgtttctccgtgtgacgtgtggcctttgagatcaactctcctgtaccagcgtaggccgcatgagtaggggggcgggctcccgcggtcctgctcggcggagtggcctctctgctcctgtcttttgtttggatgccggcgctgctgcctgtagctcccgccttttgttgctaccccgagtcttgctgaccatgggcctctcgaagccctccgacccagccctcgccggcctcggattccggctctggctacgttccgggctcggtctctacaggctatgttacttgccccaacgagaaggtcgccaagaagatcgccacgaccgtggttgagaagcgctagcagcctgcgtcaacctcatcctcagatacatccatctattagtggaaagggagatcgaggagacagtaa

SEQ ID NO: 1279 - DNA, 244 bp, Homo sapiens
  Genbank Accession No. AA476216
ttttattttttcagggtcttatagaaaaatataactttaataaggaaattcaactaagggtaggagtactccaggaacaatggtaatccccacatgatgatctgattctcttctgggagcaaaacattgcaaccagacaggatggacaaggcatctaaaaacccagtatccttcaccttccgaaaggagggagggactgtagagttgcccaggaaaaaggtcaagagtcttccttctcctggaa

SEQ ID NO: 1280 - DNA, 422 bp, Homo sapiens
  Genbank Accession No. AA476260
ttttttaaatttttaaatggttctttattcataaacttgatgcaagtttacaaaatttactgtacattgccaaataaatctgcaattaaaaataaaatccattaaacaaagcatgccaaatgtgcagctatcagtctgcttgccatcaggatattaaagaattcaacaatgtattcaagatttagccttaggcttaaggaactttactgatttaaagaattctgccttgtcacttgttatctgagcaactggcaatcagaactttatacaaatgtaatcaagtgaacaagaataccagaaaatctatttactgctctcttaaccaaaatggaatcaaaagaaattaaacacacacaatgtagaaatgacaagtctctcagatgtggtttacaaagttaaaaactgaatctcaaagctaatgc

SEQ ID NO: 1281 - DNA, 253 bp, Homo sapiens
  Genbank Accession No. AA476324
tttttttgaggattgaaaaattatctttattatcttgagtgggagctggagctggaagtctccacgttctccctccaacaactcagctcccattgtacccatctggggacttagatgaagttacaggtcagttattggacagctcacaggcctcttgattcctaggagtcaataagaaggctttggagtccaggcaggaagtcagggacttgaattcctccacacacttttcgggaggatgtggtgagcgatt

SEQ ID NO: 1282 - DNA, 219 bp, Homo sapiens
  Genbank Accession No. AA476333
tttttatctcccaaataaactttattttgaaaagaatatcacaatatagtcatgtaaatttaaatatggcacactgagcagtattgacgcaaattatatagtcatgtaaccatgtttcggtcaatgtacaatatatatatgatggtggccccacagattataatggagttgaaaaattcctgtcacctgctagggatgtcttgatcctgaccctgcata

SEQ ID NO: 1283 - DNA, 233 bp, Homo sapiens
  Genbank Accession No. AA476346
ttttgagtccatctgtatttaataatactgcaattattaatacatgtttatagaattagtacataaattaatgccttttcagatccttcacatccagcttttttaccttaagttaatatccatatgtatgagaaataaacgtaatctgataatgcttagttaacttgatgattggacaataacaatatgaactatattggattcactgttacttcctctttattcctgcagtg

SEQ ID NO: 1284 - DNA, 177 bp, Homo sapiens
  Genbank Accession No. AA476352
tttttttttttttaaaaaaaaggttggaaaaattactttatgaagccttaagcactaagaataattaattaaactgtaatccaggattagatacaatttaataatagttcaattccaaaataaaagttattgtaggtaagaccatgaaatttcctaacacttgattttaatacattg

SEQ ID NO: 1285 - DNA, 241 bp, Homo sapiens
  Genbank Accession No. AA476473
tttttcaggcaaatatgtttaattttttaaaataactgatggcaaaataaaatatttacatcacatcatactgtgtaaacatgtaaggtctctgtacaaagaaatatacatgcaaaataatgtaaaaatttaactgaaataataaaagaaacaatacacaaataaaaattatgaggttacgaatacacatccagtttcgaatccaatttcttttaaaaagtttctgtacaattttacaaga

SEQ ID NO: 1286 - DNA, 317 bp, Homo sapiens
  Genbank Accession No. AA476749
ttttttttttttttttttttttttttttttttttgttttgttttctttcacagatttaataccgcgatctcagccaaactccggccgagaagttgagaaatgtcttcacctcctctcgacattcgttcgtgcttcttcgccttggctggagcgataggggcgagcaggggtggggccggctggtgctgctacgcagggccgtgcacgccgttaataagtgacataaaatgtctacacgcataagtaaccgtacttagggcttctgcaagggccaccagagcgcctaggtggcaagtgggcgccgtttcacggccgcg

SEQ ID NO: 1287 - DNA, 466 bp, Homo sapiens
  Genbank Accession No. AA476754
tttttagcaatacaaaagataaatatttattcagaacaaaacttttaacaatcaattttacattctaagccacaaggaaatagcaaaacatatagcaaaggaaaagcaaacactaaaagaaaagcagtgtactgtcttttctactggataacacttagttggcccatgacctctcgcttggcctatctcccaagtacattttagagttaacagctcactcataattttgggttaaaatccatctttctcctgagaatcaggagttgcacatgagctccagctagctgcttctctagggttcgtagctattgaggctaaggtgcaaatgtaaacctttggtaggtttctttacacaggggcaccccatttctcactggtggcaatgaatggggaaggggtagggcctccaaaggacctggcacactgtaatccagaagtggtgccccagggagcaacgaatgcaccc

SEQ ID NO: 1288 - DNA, 295 bp, Homo sapiens
  Genbank Accession No. AA476944
tattctttcaaaatatattttattagcggcacatggaatgtcaagttaagcaaattctttccagagagaaggtgagcctgacagactaaaacgttgagcacggatgatacagcagaaataacatttccagtgtaatgagagataaagaggaatactgcccaccgaggaaatgactttcttcaccatgctgaccacactgcacagcgcccgatccggctggtgaggatggggaggtgggaagaatctcaaagcactggacagggtgaggactcaggaagtcacggggtcagcccta

SEQ ID NO: 1289 - DNA, 246 bp, Homo sapiens
  Genbank Accession No. AA477119
gagctcccgtgagtggttaatagggtgatagacctgtgatccatcgtgatgtcttatttaaggggaacgtgtgggctatttaggctttatgaccctgaagtaggaaccagatgtcggatacagttcactttagctacccccaagtgttatgggcccggagcgaggagagtagcactcttgtgcgtgatattgatttcacggaggatggtggtcaagggacccctatctgaggggggtcatccatgg

SEQ ID NO: 1290 - DNA, 283 bp, Homo sapiens
  Genbank Accession No. AA477316
ttttttttttttttttttttttgaatgtaaacagttttatttagaaacagataggtacctgttcgcattgcagaatataaaacttggtttacactctataaaaaataaccaatatccaaattcaagagagctagcattcacagaacacacaatatgggtgtgtagctactgttcaccagcctcaggttgatttaaacaaacaaacaaaaaaaaaatttcaaagggatcattcaagatgaccgtataatgcttgctgctgtctttgcagattaaggtttgcttt

SEQ ID NO: 1291 - DNA, 493 bp, Homo sapiens
  Genbank Accession No. AA477549
tttttttgccagggcggaccgtctttattcctctcctgcctcagaggtcaggaaggaggtctggcaggacctgcagtgggccctagtcatctgtggcagcgaaggtgaagggactcagcttgtagcccgtgcctgagtagaacttgttctggaattccacccagtgcagccgcagggcgtgcaggaaggctgagagtccctccatcaccagcaggatagccacggtcatcacggcaaaggcggcaaagatggggaccagcaccacagccgccacgcccacctcccggcccaggcccaggcctatgcgcatcaccatggcccacagaacctcggacagctgggcgtgggccaggctcagggcccacaggcgcaggtaggaggcggtgttggagacgcagcccaggcagaactcgatggtgtggatggcctggtgcatgagcactccggaggggacgagctcgggctcctcttcatcatccaggccccctggctt

SEQ ID NO: 1292 - DNA, 356 bp, Homo sapiens
  Genbank Accession No. AA477561
cttttgttcagcttttactggaaactgctgtctaggaccacctgccctaaccaggaataaaggcaagacagcctggagaccagtttgtttcttcagctgcaaacagctgcctgggcaggcaggtgacacaaggcctctgtccccagggatgggacctgcagggtctgttcacccagggcacccacagtcctgaagtgcaggcccagggtctgtccagctgggagagggcagaggtggcggctgggtgagttgccggcctcagctgggggcctgggggaggccttcttcagcagagatgtgaggaagctccccagctcctcgtcctggtaggtccaggagaccagcagcaccttggt

SEQ ID NO: 1293 - DNA, 186 bp, Homo sapiens
  Genbank Accession No. AA477919
atcaccagctacctggtggcgcacaccctagggcgccggatgctgtatccaggctctgtgtacctgctgcagaaggccctcatgcctgtgctgctgcagggccaggccgaactggtggaagagtgtaatgggcgccgggcaaagctgctggcctgtgatggcaatgagattgacaccatgtttgtg

SEQ ID NO: 1294 - DNA, 263 bp, Homo sapiens
  Genbank Accession No. AA477978
ctgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtcccagatgctctgcctcccgttccaaaacccactcatcctcagcttgcacaaactggttgaacggcaggaatgaaagataaagagagatggcttttgtgataaaa

SEQ ID NO: 1295 - DNA, 283 bp, Homo sapiens
  Genbank Accession No. AA478017
ttttgctgctgggtcgggttttatttcaaatgcagccacagaggcggtttctgcacaggtacgtgatccgactccacaagctcccaccaggggctccccatgacccgcaatgacgctgtgtggggtcaaaggaaaacaggccacagccaggcccctcgatggacgcaggcaggggaccaggaatgcggcccacgcagggggatcgggaatcaggcggaaggtgcaggtttgcagctggcgggaggagccagcatgccccaatctctaaaatattcccggtaga

SEQ ID NO: 1296 - DNA, 367 bp, Homo sapiens
  Genbank Accession No. AA478104
ttttgttcaataaatgtttattgctttttcaattattctatttacaaacaacatggaatttcttggcctcatgatacaaagcgatactaaactgtagtctagcagtgtaggcaacatcatgggaaccagaaaatggccaggccttttgcactagccaacactttccagttgaaaatactattttacacatatagaacacttataaaatgcacttgcatgtaaacactgtaaaatcctgccatttaaaattctacactcaaaaagctctaagtacatcaaaaaatagaagaaatttctaattgataccaataaggcattttaaaactacaaacagctttctttattcaatttcaaagctaatactctg

SEQ ID NO: 1297 - DNA, 379 bp, Homo sapiens
  Genbank Accession No. AA478298
gggaacgtgaattttaatgagggggcagaccgaggaggtggtggctgcccggagatcagggccaggctgtgctagatggcgcctggaaggggggtcacccaagtctccctgctgtcatttcaggaggccgacccaagtctccctgctgtcatttcaggaggccgaattttttcccaatcccagagaaggtgtcagaggcctggttagcagtcttgtcgatggtttcctgggtggtcttggccagctggtccatggctttctgccccgcctctgtggcctggtccaccacttgctgagctgccgctccggccgctgacacggcttcctgggcggtcccctccacctgttgcttcaggtcctgcaagcacttgcttgccat

SEQ ID NO: 1298 - DNA, 438 bp, Homo sapiens
  Genbank Accession No. AA478300
  unsure (1)..(438): n = a or c or g or t
ccctgtcaaccttttattgggagtggaacacatgaggttcagctcgtgccgggcactgtacattcactgaagcagctcaaggggctcagccgancactgacgccacactgagcaggatgcacggcccggggctcacactgtccatggaggaggtggggtcagcccgaggtgggcggatggtggcccgagacaccgagagcttggttctgggactgtggctcagctgacccgtggcacagctgcacctaagacatggccctggctaggcgggaacagctcacagtagcgatacattcacaggacacagttggtgtccagaaaagggggctcagaacacagtttctacacaagcacttggcacccacacgacagagacgtcactcaagcagcacagccacaaatagtttacagcagctcatgcccggcatccgcccatgc

SEQ ID NO: 1299 - DNA, 411 bp, Homo sapiens
  Genbank Accession No. AA478415
tttttttttttttttttttttttgtagtaaaatggccagatgtttattattttgttacattatttccattgcatattccacatctatttattttcacttttatttattatcattatttttcacaaaggtacaaggaatttcagaaacaacattaaaacaatcattcaaactgtttcaggcacggtttcaattaaaagcatagatttgatttctgacttcctgtttccttctatgatacaatctcaagttttgtttcaggaagcacaattattgtagcgttaaggtggatacctgccaaagctcatctcctagtgctgtcctcattctcagaaagttcctgagtcaacagaaaggggacgcccagggtatggaataaggagatgagagcatgctctgccaactggctgggac

SEQ ID NO: 1300 - DNA, 244 bp, Homo sapiens
  Genbank Accession No. AA478416
tataatgaacagaaatttatttggctcacttctggaggctgagaagtctaagattgaggttccacatcttgtgagggccttcctgttgattcataacctggtggaagtcatcatgtggcaagagagagggctacagagagcaagaggaaactcactcctgagatatcaacattaatccattcatgaggctgaagccctcatgatctaaacaccccccactaggccacacctgccagtatcatta

SEQ ID NO: 1301 - DNA, 234 bp, Homo sapiens
  Genbank Accession No. AA478422
ggacaccgggcaagatccccgcagtgccagcttcccaggactcaggattccagtcggccatgaagcaataaatacaaacatgccccacaaggtgagaataaagccatcaaggtgatgaggaagaagtcacggggattttcttcttctaagtccaagcacagtggcaatatttcaagtattgcaaagaaaaacacacgtgtgtgtatttttgtctgttatgtggcgtgtgaccct

SEQ ID NO: 1302 - DNA, 260 bp, Homo sapiens
  Genbank Accession No. AA478441
ttttttttttttttttttttttttttttttttttttacaaggacacctctttattgctgttagaaaagggtggttacaagtttcctggacatggagagggacactatccctaaatccaagggaaccagaaaatttatagtatcaaacagaggaaagcgggggcagaacagagctgggcttaagatcagaaaattttcttcctgctcattacccaagcccagagttcttgccccagcttcaactgccaagataccaccctt

SEQ ID NO: 1303 - DNA, 305 bp, Homo sapiens
  Genbank Accession No. AA478556
tttagccctttacaaatggagaaacccttaacaaaaggcgggctgcagtgtgcccagccctgctttctactcagcagagcggacgaagtgagcagggtggaggcctcctgactcatgcgcggacctgcggctgctgaggacaaaggcccagcgcctccaaggagcttctgtgagcacctcggctactgcagaaacgtgaaaggaggtgacgtgtcggaaacccccaacttcattttcttttccagtcgcttctacacctggggccacaggacacagtaaagggtgagacagcacctgcgtcacga

SEQ ID NO: 1304 - DNA, 392 bp, Homo sapiens
  Genbank Accession No. AA478599
acaacagctgatttttatttttcttcttgattctcttctacagtttccaaattctctacaatgaacatgtacttctttttaatatcaaaagacaaaagaattggtacgtaaaaagaacatccttcccatcttcaaggtcaagattgaacgctgactcctgcaggaagtcttccaggattcccaggcaggaatgatggctccctgtccctgtagctccaggagttcttgcttcacgcacgcctcacataccagactgaatgttggcaggaggagtgaccaggtcggtcatctgtgtccctaccacctacaacaggccagcaatctacccgtgtgtgtttgttggacagaattaaccatgatgggcggccgagggcgctggagctatttggggg

SEQ ID NO: 1305 - DNA, 401 bp, Homo sapiens
  Genbank Accession No. AA478615
tgaaaggtttaaacgctttattgtgcccaaaaaaaggcccatggaatgaagggaagagccgcgcagccgtgagccgggagcgattgtttgtcgcgcacccaaaggcaaggagggtggggagctgggaaaggatgcgcggcctccggtgccccgcgcgccatgggcccggccaaccagcgaccccgcccggtggcgaggcgcggcctcggccatcggcgccctaggggccagtaaccatgacgacggccgttgccaaggccgagagccaatagaggcgtcgcgggcgctgtttcaaaaacctaaagcaaacaacgaaaaacgctacatcgttgggggaggggaaagactgagaggacccggggcccctccctgaggctcagaccaggcctcgcggccccggc

SEQ ID NO: 1306 - DNA, 327 bp, Homo sapiens
  Genbank Accession No. AA478971
  unsure (1)..(327): n = a or c or g or t
gagggtgcttttggtgcggcctgttggtcgggctgaccattggttgcacttgtttctacttcgttagacatggcaagaaggcaggcagcaaacctcagtaccagtggacacttggtgacaccaggcgatcccgatggagaactctcaaataaacataacctcccacagacaccggctagctattgcctccgtgaagcgagcatgacttccccgcgcccggagcctccaggctacagcgcagttantgcgtcgggcctcgcttaaatagccgccggcgggagcttcggagccgcgcggccactcccggcgagagatatggttctaatc

SEQ ID NO: 1307 - DNA, 372 bp, Homo sapiens
  Genbank Accession No. AA479044
ttcttttttttttttttttttctcatcaaaacatgatttattaattttaagcaagagtaagcatatgtgatagtggccagcttggggatagaactcttcctggttgatgcacagttcagcacctgttgggtcttggctgttgggatgataattcttttgggtgaggggaacagccgtggtcaaggctgcctgcacccccatccaggcacaggaccctgggcaaagtctcaaaagaggtagtgtttttactttcgcaccaacaatacaacataagtattgggtacaaaagaggagatttccttcccctctacctcaacgggcaaaaggccttccatcttcagaagaggcttgtgaggaccatcggttgatgac

SEQ ID NO: 1308 - DNA, 248 bp, Homo sapiens
  Genbank Accession No. AA479096
ttttttttttcagattgaacgcctttatttttctcaaatataaaatcagagtctcctgaggcagcacatgaactccagagagagaatcaacaacaagaatcacattgctaaaaagaacaggcctatatctacctcccgccctccctccccaccaatctgggagagggaagagcagagatcatggcctcaaagctctcgagcacctggctgaagcccagtgctgggcgccatgtgagctggaggaagcc

SEQ ID NO: 1309 - DNA, 557 bp, Homo sapiens
  Genbank Accession No. AA479132
ctaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctattcggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaaattcctgctacagaaaagccacctggtacgttttgtctcatcaggattgttttaaattctaaactataagtttgttctgaggggcttttgcaatgatagcagataactgtacaaatgtacagttagttatagaggttcttgttgaaatgaacttaccatctgatgatatgtatgtacagctgtgtacttgagtcttttttagtttacttagaaagac

SEQ ID NO: 1310 - DNA, 534 bp, Homo sapiens
  Genbank Accession No. AA479139
tgtctgaatcaaagatttttattgattctcctgccaaacacaactgatttccatctacaattactttttaaggtaagaaacagtaagtcaactgaacaaagagctgggctttgggcctggaacgtgattacacaccgactgagaaatgcaggacctcagggtggggtctagtcaggctggccgcagcagggcacgaacctgcctcagtgggccttctccaagaacgctctgcagcacctgacacactgctggtacaccgtctcaaagtcagagtcattcccataatagggatcttcacataaaaattggtttttgtgggatcaagctcccaagtagttcaattttaagcttgcaagttttaacccgcatactttttctattcaaaaccccccgattgctttcatccctacataggtatatatccaatgtgggaaaaacctccttgggtaatctgccggggaaacttggctcatgggaaatccgggcctcttcatgcagctctgcctccgtagttcaggggggttcccaaactca

SEQ ID NO: 1311 - DNA, 447 bp, Homo sapiens
  Genbank Accession No. AA479148
ttgatggtgtgaagaatttgtagctttaataacagattagttagggggtagggatgatacttctgtcctacctgtgccattcttcaaaagcagagactcccttcacctaagagctagacaatgcctgcttcatttttgaatcaagaaagcagaacataccttacacacacatattcatcaaatagacttctttccctaattatgtcttcctcctttgagtttcttatggctaatgatcatgtcttctgctttcagctcttgcctcttaaaaatctcaacccttaaatctttactgatcattaaaaccttcatgaacccctaaacttataagggtgaaatctgcagtaaatggattagaacaatttgtttactataaatgaggctggaaaaattggtgaagagccccacagagatccggaatgcagtaaccttgcccagaatccttat

SEQ ID NO: 1312 - DNA, 410 bp, Homo sapiens
  Genbank Accession No. AA479266
gtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcgtccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggca

SEQ ID NO: 1313 - DNA, 507 bp, Homo sapiens
  Genbank Accession No. AA479488
aatgtctgtctctctgatcagtggaaaagtgaaaatttctagtatctagcactaacgtatgacccaactttgagggatcacaagctagaacaagttgaggatttaaaatcctggataattatatacttatagctcatgagcataaagctcacttgaccatgcagaaatgctgggaagcagggtgcatggcatgggaatacatctccctgatctttgagagagcctctctggatattctttcagagcatgagccaggatgtactgactactttcttcacacatcagttgccctttatgatctcagttcataaactctttgtggtatgtagcaatcaaaagtcatattacttctgtaaaactaacattatatagggtgtatagtcccagacaaattatatgaagctagatttttcttgccctggcccaatttatcattcctcctcctgcccacacctacctccctttaaatattttaggttgcagaagcacagctgaccagaaatttgc

SEQ ID NO: 1314 - DNA, 522 bp, Homo sapiens
  Genbank Accession No. AA479498
gcggccgcctggcacacactggtccccttggcctccaggtagatgctagtggagggcgcccgctgggacgaggcagaggcaggcagcaagagacagcgcgcagatgacgaacagggagtcgctcaccaggacgcggacaagcagcagggcccagggtgtgccacgccgatgggagagcacagcacacagcacgttcaccagcagaaagagcagcgaggcccccacaaaggcccctcggacagcgagcaagcctcggctcatctccggccgacgcttcaccttggccttgaacaccacctgggcaaagtagaggttcataagcgtcaaggtgaagaactgcaggcagacggggcagcagtagagaagccagaagggcaagggcccaggcggttggcgcggggagtatctcggaagtagaaggagaagagggtggtacgcaaggcggcccagagcagacagagggccaggaacaccgtctgatagctgagacgcttgtgcccatacagaagcaccagccagagc

SEQ ID NO: 1315 - DNA, 280 bp, Homo sapiens
  Genbank Accession No. AA479727
gaccagtttcaccatcttttttattggatacagagccataaattctctgatgcccatgtgagtccttttaaatacatacactcaggtacattcagcaaagggcatcttacgggtgacatggagcaaagtgctgggatggcgatgcctgggtggggcagagaagtgtggccagggaaggccccctgggcgctggaggtacaggcaccacttcagaaacaaaaataaaaccaaaaattgctctccacccctctgcctgtgcttggggctggggaagctaccc

SEQ ID NO: 1316 - DNA, 201 bp, Homo sapiens
  Genbank Accession No. AA479797
agagaacctgaacatttaatatggtcagcaccttgtaaggtgaaggtgtgttttttacacaaattataaataatgaaaaatatgcatttagaaaaagaagcagcagtccccttggcgggccggctcgaggactctttggttgagtggcaggtgaggccctgggtccagggtctgtcagagcccccctaggtcatctgccag

SEQ ID NO: 1317 - DNA, 416 bp, Homo sapiens
  Genbank Accession No. AA479881
ttttcactcagaccaacagggagccaggccctgcagggcgtttagttttgacaccactttgtttcaatacaaacagtccagaaagaaagtcaagtccctctgggggaggggcaaggggaagagtggtctgtgttgcttgggagcccaacctacaacccaaaggtgggggctgggctgagactgccggtgcggcaggggaagatggcaccaagaatgacagtgcttggctcagctgccagagggtgaggcccacagctctcactggcgggtgctgtccaggccaagcccagaatgatgcagaggaaggagctcagccccaggagcctgcctctgcctctcacatcctctgcttccctggccagcatcaagctcacagcatccagagtcgaatcacagcagacaagaccctccatggc

SEQ ID NO: 1318 - DNA, 418 bp, Homo sapiens
  Genbank Accession No. AA479885
tttttttttttttttagggttgaaatgatgtgcttttatgggaaacaaaaatatccaacaacaataacaaaagcccttcaatctcgccaagttcttaaccagtgacaataaggcaacttccatgattgcgtctggctggggatgattctaaagggtcaggaaagtgaaaagacattggccaaaaagagaagttgcagggagggctgacatcctacatgagaacacagcagacttccctctggcccctcaccctatcaccccttcaatttagaatctccccccaatctacaaagatccttcctgaatttcctcagatgcaatctcttccagaaagctttcctgggtctgctctagctgcatatgacttttcattaacatcacgcacactttctcattccttctccgatcactttctgcc

SEQ ID NO: 1319 - DNA, 275 bp, Homo sapiens
  Genbank Accession No. AA479945
gactgttcatggccatctttattcccagtgctggctatcccaagatactgccaggccacagccaacccccacctctgccaatgtgactgggtcaccaccccatacaccagagcagccttgagccctgccccaccccctgccctgcggaagctaagtccccagctataagaccctgcccctcctggtggcccaggaccctcaaagatgcacacaggggccccagcgagggctgcaccgtcattagccttctcctccaggctgggctgccaagcagc

SEQ ID NO: 1320 - DNA, 421 bp, Homo sapiens
  Genbank Accession No. AA479961
tcatctttttgttcactaattaatttagctgtgatacttggagtatctgacactctgtcaagaacatctgataatgttgttgagactggcaaatgaagagtacggaatttgtggcctgctccatacattggatgctggatgacgtggctagtagcattaattctacctttgtacagtggacatggagactgaagaaacattgtcactttctcatcttccagcatcaactgtaaaaataatcttcgtataaaccctgaaatgttcccagatgttggaaggttccctctttgaggagatgtctgaaatagttcacaaagaacctgtgccatcagcttttgattattaggatggcatgaaatgcactgtagaaagaacgcaacagttgcattctcaattgctgtgcgctgttgagtagtcagtc

SEQ ID NO: 1321 - DNA, 452 bp, Homo sapiens
  Genbank Accession No. AA479968
tttttttgcaagtctccactggtgttattacgttatcaggcacaaaccccctccagacacgagagcctcccccacaggctcccagtgaggagccatcacatgcccaggccagccgaggggcctcaggatggggatctgggcaatggcagcaagctgggcggggggtgcagccaggatgacagcagatctgcagggcggggtcctcgccccgggccaactggctggggccgacagtcacagctgcgtctaaatgggccttgagcagctgaagctgtttcagggcttgcagcacctctggggtggccccggcacacaccccagcaggttgtagttctcaccagggtccttggaaaggtcatagagcagcgggggctcatgagcagtcagagagctggaggcgtggcaggcagggtctgcagtggtatcactgtgggcagagactgggtgaagaa

SEQ ID NO: 1322 - DNA, 493 bp, Homo sapiens
  Genbank Accession No. AA480975
ttttttttttttttttttgttactaacgttttctatttattcattaataaaaagtgcatagtacaagccctttatcccaatccaagtactcagaaaaagattaacaacagaccctggatggcacagacataatttgtttggcgtgatttaaacatataaaatcagtaattaacatttagcatatcacacgaccacttttgcttttaacaaactaatcttcacacatggtaacaaatacctatgatttttcatttagaaatattataagaagactaaacttactattgcaacaacaaaaatttaacccattaaactagaaactctcttcatttttccttcttcaaattactgttttgtgtcttaaactgagttggtcaaatttgagcacataattcatgtagagtgacagactttcatttagagtgatagacttccaaggttcctttgaaaatttaagatactggtaattccataaacactcccacaccacata

SEQ ID NO: 1323 - DNA, 225 bp, Homo sapiens
  Genbank Accession No. AA480991
ttttttttttttttaggaggagaaagaccatttatttctccacccacagtgggactgtgtaggttttgaaaagagcaatcgctggcatccctttaaatcttggctgactcccaccgtggcagccaatcagcagaggcggactggtcgagttgcctgggcacaggcccctggttggccgaagacaattagccaccccactgcccactcccaacgaaagggaaattg

SEQ ID NO: 1324 - DNA, 172 bp, Homo sapiens
  Genbank Accession No. AA480997
tttttttttttttttttgccactttgctatttatgtacacatacaaaatatataatgatgctcaacccatacagcacaaagattacaatgtaacatcacacattcaccaccagtgaggggagaaacccctttatacaatcctctgaaaaaactgggctaataattaaaatcc

SEQ ID NO: 1325 - DNA, 375 bp, Homo sapiens
  Genbank Accession No. AA481057
ttttttttttttttttttctggtaccagttttatttataattaaccacatacaaatcacttttctacaaaataatggttaacatctattccttaattcacagaaatatcacaaaaccaaaatccttcccacgatatattactatttagtctaagctttaattcaaaggttgagaatgacgaattcaagaatttctttcatacataaattgctttccttagttctgcagatgggtaatctgtttgagataagcactgtcatgtttcaaccttagagaacaaaaagctatcaacaagatagtggtaaagaaaatgctagccaaaaaataacactattgagaaataggtgcgtattaagtgcaatacttacaacatct

SEQ ID NO: 1326 - DNA, 400 bp, Homo sapiens
  Genbank Accession No. AA481060
ttttttttttttgagagttcatcttgacttttattacacactagacatatatgaactaaccagagatgtgcatgattctctgtactcttaaagtcacaggaaatataactccacctccccctttttttctgatattggagtagcatttcagattttggagattagcttagggcaaagtaaaagtcatggaaggcagtgtataaataacattaattatgaagctacttttcagaagctagtagtaacttgcttagtaataaccacaaggttgtacagcgttcacaatgttggtattaatcagctacatattttgaacatctactgttactggataccaaagaaagtgagttatttaagaatcttccattcttgttataagcttcctatgatccagtaactt

SEQ ID NO: 1327 - DNA, 394 bp, Homo sapiens
  Genbank Accession No. AA481420
ttttgtcactctgttcttccatgcctttattggtaacagcaatggacaagaacaataccaggcatagcagacaccctagcccagtacctgaggtgccaggcaggccctgaaggcacttggcacatccagtcccagcccaagatccagtctacccaggccatgtccccgaatggcaggaggcgtctgtccagtttgtatgtgtggatcagtctctctgagtgtctgagccgctgcctgcagggcccccccattctccgcacatggtaggggctgttaggaacatagcgtggcatcccccggtggaccactgggccccagtgctgaccatggggattagggccagggattggaggtggcagagggccaggcacaaagttcactccagggccacatc

SEQ ID NO: 1328 - DNA, 545 bp, Homo sapiens
  Genbank Accession No. AA481432
tccttgacagtgtaaacactgacattgtactccaggccgggactcaggttatcaaaagtgcaggagctctgatcagcatggaccacttcttccaaagaatttccctgctggccgtttgtaggggttgtggtaattctataaccagtaatgtctggggtggtgctcctctcccaggagactgtgagcactccagtgtcagggtttgcctccagatgcaagtttgttggtggagacaatggtgtcaccactttgtttacaattggcgcatctctttcctgtccatctctcaggacttggatggtgtagacgtattctactcctggagtcaagccggacacaacgatgcttcctgagtctgaagtcacttctcgtggtgcctctcctccctggcttggtcgtacacccagcttaaaaccaattcttggagcaggcgtccatgtgatcacaatggtggtctcagtcacctcggtgttgtaaggtggaatagagctcccaggctgcagtgtggtagagactccagtggctttggggctctcttggttgcc

SEQ ID NO: 1329 - DNA, 313 bp, Homo sapiens
  Genbank Accession No. AA481526
ttttttttttacttggtaaagtcctcaaagtagattttatttatacatttcttcaaatgattgtggtattttaaaaaatctctcccaaatttgatgacatagggacagtggtgagaacaaagtatccctaaaggaaacaaatatcgattggtgctttcctagctcactgagctaacactcagaagccaatttattctataatcctaaagaaccttaaatgtgggtttgtttgaattggccttctgagaatcattgaaataaaggaaatattacggaaaagagattagtttccaaaaatgtgccgtctttgaaa

SEQ ID NO: 1330 - DNA, 395 bp, Homo sapiens
  Genbank Accession No. AA481670
ctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggttt

SEQ ID NO: 1331 - DNA, 475 bp, Homo sapiens
  Genbank Accession No. AA482007
tttttttttgtaagtacaagtacacattccttgccaaactttattgtgattaaaattccagagacagtaccagctccacatacctctagccctgtctttgccctagttcccgagtgtccttcacccccatcttccaaatcatctctggtttcacggggaagaaaaaacctagggctgctgtgaatgtgccctctcaggtccctgagttggccccaggtagagctgtaagagatcaggaagagggcctccctgcctgacggcgatgatcctggaggcaacgtgtggagcagaaagagaagtcgaggtagtgaaagggagtcaggccttggagggatgccccacaactccagcagcgtcgagtattgacgattgcagagtccaggattggagaggtaggggctcccaactgggcagcgagtcggcgctctgcagccagagctctcttctctcggtcactgagggcggcaaatcgcct

SEQ ID NO: 1332 - DNA, 347 bp, Homo sapiens
  Genbank Accession No. AA482104
aaacgaaaacgaggactttattataaaaaaacgttggaccacgttgggctgggcaccaggacagtgtcctggcacgtttccaggcgagccgcgcaggctccttggagcagctcctcgggcaggaaaccctgtacgccagggattggagaggcctgcgccaccctccatgcaacgtccagacaggtggatgttcagcagcccgtccaaagggatgctccaagcgctgtggggtggggccagaagcccgcccacctgggccctggaggaggctggagtgtgagagcctctgtgacgcgcatctgccgggctactcatacagccagtgcccagcgctgtcctcccagcag

SEQ ID NO: 1333 - DNA, 199 bp, Homo sapiens
  Genbank Accession No. AA482127
caaaacaagacaatgttttaattgtaaaactaactcgaggcatgggtgggcgggctggggctgcgctgaccgggcaggaacctggttcttcaggcagtggttctgccagggccaccccgcaggacagggaccatctgtcccccaataagggcaggggctagagtgttataaaatgacaatataaatagacttctagaaa

SEQ ID NO: 1334 - DNA, 126 bp, Homo sapiens
  Genbank Accession No. AA482224
acttttggtttcatattttttcagttaatttcagtaaaaacataatatataaaaggcattgccaccattttcccctcctgggggtgatccatcaagccagtgtgggctgctccagtggttcatagc

SEQ ID NO: 1335 - DNA, 147 bp, Homo sapiens
  Genbank Accession No. AA482319
ctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagta

SEQ ID NO: 1336 - DNA, 523 bp, Homo sapiens
  Genbank Accession No. AA482546
ttttttttttttttttttttttttttttttttttttttttacagggtaaaggctctgttgacttcagcacgaccaccccagccccaggcaggcagaacagctaggtgaagaggcggacagtcccgtctgcccccgaggagaagacccacggctgggtggggtggaagatgacgtccagcactcccagatctcgggtcagcacgtgtcccttcagcaccttgacgggcaccagcaaggggttctgcagaaggtcattgtacaccatgccatggcagacgatgacactgccgtcgtccgagcctgacgcaaagagtgggtaccgcgggtggaaggccacagcccgcagagccttcttgtggtgtctcagcatcctgtatggcttggtggaaagatccaggtcaaaccacaccagcttgctatcgtagctcccacagatgacgttgtcacctgcagggtgcaccgccaggctggacacccatttgcagttgggcatcagcttcttggtgagctcctggcgcacaag

SEQ ID NO: 1337 - DNA, 427 bp, Homo sapiens
  Genbank Accession No. AA482594
ttttttttttttttttgacttatatcttataggatttatcacaaaatgttactgcccagtgcatttttgcaaacaataacaattcactgagagtaataacattcacatatgtaattagagtttaaaaatgtaaaaaacttagggtaacaaacactttaaacttattttttagacattcaataagcccattctcccacaaactgtttgattacaaagaagcacaatgggttaactgtggcaaaacataagaaataaggcaggggaggcagatacagacttgagaacataaggatatccaaacaattttgtcaatatcaaaagacaaaatcaaaacatcttttataatataaaacaaatccatataattaaatactaattaggtgaaagattatagggtatataacatttattttctctacataaattt

SEQ ID NO: 1338 - DNA, 406 bp, Homo sapiens
  Genbank Accession No. AA482613
ccttttttttttttttcatggtcacttctttatttttgatacaaatgtacatgacacgtcttgacagcccacccaccaccacacaggtagggcctggccccagggaagaagcgggatggggagagagctggtgggtcccaccgtctgcctctccagccttcccaggctgcagccaggttcccaggcctccagagggtgggaccacagcaggtgcaggtagtgatggtgggtgctggccttgcagaggttacggggaggggactcagctccacagccaccagctgagtcggggaccccggggagccagccccaggctcaggtgctcagtcctccaccctagccagcacacattccccctccacgcaggagcaggaggagatggagggaagtggtttttgatttaagt

SEQ ID NO: 1339 - DNA, 398 bp, Homo sapiens
  Genbank Accession No. AA485060
tttttttttttatcagaaacgtgtattctttttcttttaatagtaaacctctttacaacaaatatagtgaaagagttttcaaacaaaactcataagaatctcgaggactttgtcttttcttattgtgtagaatactaagaaagcatcaccatacagcacgaaaagaaatattgaaaacaaatcaacagcctcacacttggactcgccctgccccaggacccaggaagagccccaggagtgtgggtgattgtcaggtgtgggggtggggcacctccatggcccatcctgcccctcccttcctcttcctcaccacctccctccctctggagaatggggaagaggagagaatccagattctccattccagcctccctccccccatacaaataccattcctt

SEQ ID NO: 1340 - DNA, 395 bp, Homo sapiens
  Genbank Accession No. AA485084
tttttttttttttttttttttttttttttcaatgccaaaaactggtgatttatagaaatcaccctggtttatttttttcaacaaaggaaaaaaaaacatggttcaataattcagcatttgggactctggcaagtactgtctgcattgttcaaaataagtgttcctggctgtgagctctgcaacacatactgatggcccaggaaccttcttccatggttctaataaaacaaaggacccacacatggaggttacgtgagtcaacaaaagatgctctatcacaatgtgcgtaaaaagcaagtctttgaaaaatatccagatctctaaaggaatacaaacactcctatttggttttgtttttgttcatcttcagtattatattttagttgttgaggaaa

SEQ ID NO: 1341 - DNA, 397 bp, Homo sapiens
  Genbank Accession No. AA485089
tttttttttgattgtatattttgtttaatacttgcattgtttctatagcgcaattatagcaatctttaaatttactttcattacaaatatttgtcaagttttgtttcagaaacatttttcctactctcttgcatcatgcacccagacacactacaaaaaactcattcataacacagtaagggcaaacattattcatgtaaacatctttcattaatttcccataatttaaaaaaatcatagaattatagatattgaataaggctcatagttttagttcaaattccacaagagaccaaagatgctcgttaaccgtgatggggttaacttttggttgcaataaatgctgaaagcatacccctggcttctacttcttcaacatacctcacaacctaataaa

SEQ ID NO: 1342 - DNA, 259 bp, Homo sapiens
  Genbank Accession No. AA485326
aagctgtaattctttttaatgtttaacttttctttgtaaaaaacttattaaaaaacttaaatggtcagttaaagttaaaaatctattgctgcacaatttaactgattaaaagatttccagatctcttgactccaagagtcatttctttcatttcttacagatctcacacttccagatttctctttagcaaacatgatctgaaatcatttgtaggtaatcagcacttcaagcatatggaggctctggctgaggcagcaga

SEQ ID NO: 1343 - DNA, 465 bp, Homo sapiens
  Genbank Accession No. AA485405
  unsure (1)..(465): n = a or c or g or t
tttttttttttttttttttatcaatacaaatcttttattaaagatctactcataccatggctgaaatcatctattattgttgctagttagcctctcttctatagttgggtaatgttgtcttgccactgtgtttgccatctctcccaagtgaaaagaacactttttataaaaaaattaattgctccaagttttcaggcccaggggaggctctcccattctcctccttcaatagtcccgtccaggtaagaggtgatcttgtggataaattcatcatacttcactttgccattgggttcgatatctgcttccctgaagagatcatccacttcctctgtggngtgagcttctcccccagactcgctgagtttgtgaccgcaggcgnancgccatgacgtaacctttcttctccttgtccaccatcaacatggctagaagaatttctttctttgggtcctcttgttttat

SEQ ID NO: 1344 - DNA, 416 bp, Homo sapiens
  Genbank Accession No. AA485413
  unsure (1)..(416): n = a or c or g or t
tatatatgaaggggagtttattaaagagtattgacttacaaaattacaaggtgaagtcccacaataggtctgcaagccaggaagccagtccaagtcccaacacctcaaaaggagggaagccaatattgtagccttcagtctgtggccgacgcnagagcccatggcaaatcactgatataagtccaagagtccaaaagttgaagaacttggagtctgttattccagggcaggaagcctccangcatggngaggaaagatggaaggccagaaggactcagcagggtctgttctcttccatgcctccctttcacacatcggcagctgattagacagggcccacccannggctgagggtggggtctgcctctcccagttccactgacttcaaatgttaatctcctttggaaacaccctca

SEQ ID NO: 1345 - DNA, 326 bp, Homo sapiens
  Genbank Accession No. AA485431
tttttttttcttattttgaggaactttattgttacatttttgcaataattgaggcacaactacctcctgcttttccaacatcttaataaaaaagacaataaggattaacagtgaaattaaaattaaaaaatacaaaagcctaaggttctggagacaaaactgactagagtctatgtgtagccaagttgtgaatgacagtttagccttgcagagtttccttcttctccaattacaatgtgttacagaatttggaagggggtgtctttaaaaacgttctaattcaccccggtcatgaggaggaggaggaggaagtccagctcagcaag

SEQ ID NO: 1346 - DNA, 254 bp, Homo sapiens
  Genbank Accession No. AA485697
ttttttttttttttttcaaagaccacagtgctttactttttgtcttaacagaggagataacttgagggacagcccccaaggcgccaggtagccttcaggggcgggcagggttgggggaggtaggagactcggaccggcagccctggctccagcttcatcatctgtgtcttccctctctggccaggctcttcgaggggatgcaggaggctgggcacggtgagctggcagggggcttggtcttcgggtgcccagcg

SEQ ID NO: 1347 - DNA, 507 bp, Homo sapiens
  Genbank Accession No. AA486407
ttttttttttttttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcgg

SEQ ID NO: 1348 - DNA, 169 bp, Homo sapiens
  Genbank Accession No. AA486410
cagggagaggaaattctgttaattccacgtttattaatcacacagctctctgcagactagacactaaaacacacaattgtcaaaaactagaaaaatgagttatgtccacgttttaaaagcaaaactttataaatttcttaccacactcattcccaagttttatcccaca

SEQ ID NO: 1349 - DNA, 456 bp, Homo sapiens
  Genbank Accession No. AA486511
ggatggacatcataaccatatgcaaagataaactaccaaattatgaagaaaagattaagatgttctacgaggagcatttgcacttggacgatgagatccgctacatcctggatggcagtgggtacttcgacgtgagggacaaggaggaccagtggatccggatcttcatggagaagggagacatggtgacgctccccgcgggattctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgag

SEQ ID NO: 1350 - DNA, 306 bp, Homo sapiens
  Genbank Accession No. AA486567
acttgagaagtcaaacagttttattacagaactatgtgtatatattttgggtttaaaacttgccaatagctgtttgaaaggatagctcataatttattcaaatagatattttattaatcaaatgtttttggtttatcaacataaccaaatgtataaaaaatgtttttaaatacaagacataactataaagtcatgaggctgattgaccttttaaactaacataataaaatctatatggtcaaaatgagtggtgatgctttaaggtaatgattatgcgtcccatctaaggatgctgcaatggcctag

SEQ ID NO: 1351 - DNA, 414 bp, Homo sapiens
  Genbank Accession No. AA486794
ggccagccctgcacccacctgtaccccttgcccacagccagaccacaacaccagattgtacctggatagctgggattggaagtgaggaataggtttctcaccccacagataacccaagacacaaatgtgcaattaaaaaatttattttagaccaccaaaacaaacaaaacaaaacagaaacaaataaaaaaaagaaaagaaaatagtgccaggtgtgggagctcactcctgtaatcccagcactttggaatgccgaggcgagtggatcacctgaggtcaggagtttgaaaccagcctggccagcatggtgaaacccatctctactaaaaatacaaaattaagcaggcgtggtggtgggcactgtaatcccagctacttgggaggctgaggcaggagaatggcgtgaacctggga

SEQ ID NO: 1352 - DNA, 231 bp, Homo sapiens
  Genbank Accession No. AA487058
gaacgggatcgcagcatcttagaaagcctattctctgccgtggtggggagtagggagcagagggaaggacccagcacacttcaagaaaccaggcgggtgtgaattcctgagtgagcttggggcagcagtgggtggctgctccacagctcgcccctcctccagaggacccagctttttggttttggagcagccagggctgttcgccagcttgctcagagcctaccctgaagg

SEQ ID NO: 1353 - DNA, 345 bp, Homo sapiens
  Genbank Accession No. AA487161
tttaattttttattttttttagtcatttttaatgcatttttctctgtgcacaagagaaataactgatgaagtcaaaagacacactttcctttatacatagcagttaaaagtaatgcaaacatcacatgacactttcagtgaaagttacatttccaattacaaatcaaaatgcatattagggtctctttatgggagaagctgagaaggaagtcttaggtaaaaagcactttcctggcattactacactgatccttcaggctgcacaaagattaaggtcatatacagtcaatctgcaaatgttgacacaatgttacactgtaaattttctgtacaattaaatgtata

SEQ ID NO: 1354 - DNA, 367 bp, Homo sapiens
  Genbank Accession No. AA487195
gcatatggacatacaattgttctagaatcatttgttgaaaaggttgtccattctccacagaattacctttctaaatctgtcaaaaaccagttgtccataaatatgtgggtctatgtgcggacactattgtaccatgcatctatttgtttaccattaaggaaatacaatcctgtcctgatttctgaggctttgtaatagatctgaaattaggtggtgttaaccatcccacatttcctttctattctaacatccttgtggtttttcttgatattttgcattcccatatgaactttaggatcagtttgtccatctctatgataaaagacatcagggatttacaatgagattgtgctgaatgtatacatcc

SEQ ID NO: 1355 - DNA, 395 bp, Homo sapiens
  Genbank Accession No. AA487218
aaagatgaggatgcggactccaataaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctcc

SEQ ID NO: 1356 - DNA, 486 bp, Homo sapiens
  Genbank Accession No. AA487503
attatactaaactaaccaaccaaccatccataccagtctcagagggcacaaacaaatctgtcctctgcagtgctgagactacacatgtgagttagagaaatggaaaatggtacaaaggaggccttcacaccattctcacatgggccagtgctgttcatgtggttaacccatttgctgtttagactgaacactgacacttggcaagtggctacttctagaacatgtgtgggctgaggtgaaccgggcattatgtgtatgtgtgaagctatccagacatgcctggtcactgacaatcccagcaaccgttccttgctgaagagacaaaaagtagcatgaaactgtgtgagactctcattttatgattctacaggtggaatcttttagcttgtttaggacacactaagccccaattctatgccctctggttaaagaaggggaagaacttgtaatgacatacgatgtggacaagtgcattaggaacaagac

SEQ ID NO: 1357 - DNA, 288 bp, Homo sapiens
  Genbank Accession No. AA487576
tttcatgctttttatttttcggtttatttaatcttctttaacacagccattgttggttcaacaatccaatatttgaggttacattattgcaaaaataaggacatagctgaataggttatgccatcaatatgtttgttaatcctatcccttttattaaagacaaagcacagtttgttaatattgtcttggattaactctatttgtaaggttacttatagtggttcatactaaaggcaggggatttgcttcctgggccaattgtctttaaactataatttaagaaatcat

SEQ ID NO: 1358 - DNA, 253 bp, Homo sapiens
  Genbank Accession No. AA487606
catagcaatctgaacaacagtccaggctgatatttcatccccattttaggagtggtgaaagtgaagctcacagaagatgggcggtgtgcctacagccattcggaggaagtggaagggccatgggatctcacagattgctgaacttcctattgctttctattatcatatgttaatagaagcctgacatggctttagaacctccatatgtcaaatataattcaatgcactttgtaacacactcaggaaattaaag

SEQ ID NO: 1359 - DNA, 417 bp, Homo sapiens
  Genbank Accession No. AA487856
tacagtataaccgttacattttattattagttattgttgtcaatctcttaaggtgcctaattcataaacttaatcacaggtatgtatgcataggaaaaaacagtatgtataaggtttgttattatctgtggttttagacatccactgggggtctggttttagatatccactgtatcccctgtggataagggggtaactgctgtatcttttagtagaagcaagagcagccccatgtggggctaagcactggacactggtcagtttcagctcctcatgcaaagtgagggtatccttgtggctccagccttggggccccctgcggtcacctttggctccacagtctggttcttgaacccaagggcagacagctttgctacagcccaggcctgaggatgcacttccttcaccaggacccac

SEQ ID NO: 1360 - DNA, 331 bp, Homo sapiens
  Genbank Accession No. AA488074
ggctgttatatagatatatatttaatataatatgtgtgattgtggttacagatacatatttggtgctttatttatccagaagcatgagtcacatagtacataaagtattgaatacaaaattctaaagataaacacaatttttcttgaatttaaaatatatgggataaatgcttacaaatggatttataaacctttcacttctacttcattctcctggctgtgtcttccgaagatgagttgctagttgcaacattaaaaaaaaatagctccttcaaatcctgacactatatgacataaaaagaacttttggcaaatatttattcagattgct

SEQ ID NO: 1361 - DNA, 469 bp, Homo sapiens
  Genbank Accession No. AA488432
ctgacatacggataaacttttattgacataccaaagagaaaccaatattcactgaaggctgccgaatccgtatttctaagagtaaaggtgtttaattgactctccacacttaaagcactttgtatgaaatatagctacaaatatacataaagaattcagatcacaaaactctctaggacattggctgggcgcggtggcccaagcctggtaatcccagcactttgggaggctgaggcaggcggatcacaaggtcaggagatcaagaccatcctggctaacacggtcaaaccccgtctctactaaaaatacaaaaaattagccggatgtggtggcgggcgctagtagtcccagctactcgggaggctgaggcaggagaatggcgtgaacctgggaggcagagcttgcagtgagccgagaccgcgccactgcactccagcctgggcaacagagcaagattctgtctcaaaaa

SEQ ID NO: 1362 - DNA, 475 bp, Homo sapiens
  Genbank Accession No. AA488843
tttttttttttttgagtcttaatttcagagttttattgtattgcactaaaggaacagcaggatggttatacaattttctctcattcagttttgaaaatctgtagtacctgcaaattcttaagaatacctttaccaccagattagaacagtaagcataataaccaatttcttaataagtaatgtcttacaaataaaaacacatttaaaatagctttaaatgcattcttcacaagtaattcagcatatatttttatatcatgtttacttatgcttaagaattaaagcaagtatatttattactctgatggaaatatgggaaatctctcattcatgcaatatacagggataatattcaagcgaagggaaaattcccgctttttatttttgtaaatgtatccatatataatcatcgacatgacagatgaggaaacccatgaagtttcccactagtcagatatacattttcacttcatca

SEQ ID NO: 1363 - DNA, 407 bp, Homo sapiens
  Genbank Accession No. AA488872
ttttttttttttttataaaagtattttttaataaatcaatgtatttcaatgttgtaacatgatagcccaatgctatatcaaggtagcaaaagtgaagattcctggtattttgatataaacactatgaatgacagtacacttgcattcaacttcacaagaaattatcttcaggtccatgaagattctttgacagctgtaacacttttcaaacagtaaagatgtacatgtattgaaagagaagacaacgaaagcctactaactgatctgggctctaaaccatactgaagagaaagagatacaatggttgtatggctagcttgctgaaaaaacatctaaatcttttaaagaaagaaaatacagcatatatcaaagttacagagtagcttacagaaatggagtcataagga

SEQ ID NO: 1364 - DNA, 402 bp, Homo sapiens
  Genbank Accession No. AA488892
tttttttttcaactcatgaaaagctcattgctgttgggtgtaatagatgcagtttatctaatctacatttttattgactgtcatctaccaaaatattgacttaaatcctgtagctatttgatttcggactttaaattgatctggtgttccttgcggggcttcgattgcatctaaatagatgtgagagttgaaagacccataaggggcttctctcgctttacgatgtcttattattttttttttccttcctctggttgatgaaatgccagggtgaaagggatagccaaataggctaaagcacaagtgccactctagttattcggcagagtgcccaataaaggtccacgacaataccatcacacatccgctcggggatgaacaagggctgactgactgataagc

SEQ ID NO: 1365 - DNA, 427 bp, Homo sapiens
  Genbank Accession No. AA488987
tttttttttgaatgagaaaacatttattccgtctccaaacagcatcccaggccgggcatctcccccacgattttataatacactcggcacagacagagtctgggagccatggggcacccctgccctccccaggcttcctaagtaacaactgcagaatatttacataaagctgggtgttgtcaggcaaagcccttccctgctgccaggggtgggagcccggaggaagtgccatgagcaccagccccgccctcacaccacgggaggcagcccagaggccaccggcacagggtggtggcccccagatcatacagcagtgggcacaggggaagcaaacctgagtgaggacacaagagcctggtccggctccgctgcacagggcaggtgtgatggcccccacgagtctttggcagagaacgcagataatagc

SEQ ID NO: 1366 - DNA, 392 bp, Homo sapiens
  Genbank Accession No. AA489009
tttttttttttttttttttttttttttttttttttaactgaaagaagtttaatttgcatatctttgtaagtttttttcatataaaaatacatgcacaaatcataaaaaaaaacatcagaaacaatgtcgcatttggaaaaaatggtcccactttattactgccactacactgttcaggcctataccatcttgtgtggactgttaccagcctgtcagctaatgcctttgatgaaatttacacttcaataaattgacatttaaatttacacacaggtcaatggtaggtttaagactgtctctgctatgttgattgactagacagatccaggtgtattttagacttggaatacgacaatcttcacttacagagaaaatagttgtctaaaatttgc

SEQ ID NO: 1367 - DNA, 306 bp, Homo sapiens
  Genbank Accession No. AA489061
tttttttttcagtgacttatcaaaaatttatttcatataataaattatataatttattttcatctttaaacagtctacaccgaaaacatttttggaaacatcttttccttttggtaaaacaggttagcaggctgacatcagcttcatattctcatggctaaaatcccccacggttatacagttaagcatagcctttctttgtatttctcaagttgacaccacttgatataaactcagacaatataaacatttctagattttgcctaaggccttagctttaactgcagagtagtgagtaggaaatta

SEQ ID NO: 1368 - DNA, 192 bp, Homo sapiens
  Genbank Accession No. AA489091
ttttttttttttttttttttttttttaatttttaacaaaattttatttagagcattaggaaaatcatattcaaaacacagaaataatcagactataacaatgctgcatagatagtggtatacaagttccctgactctaacttcttcctaacttaaaagttcaattttcaagtcaccaggtagaaaatggtgg

SEQ ID NO: 1369 - DNA, 399 bp, Homo sapiens
  Genbank Accession No. AA489629
aacacttcactaatagagctaaactttatttccatgtttattacatgtttataacttgatgttgagtacatattagaatagacttaacatacaacttgggagaaaagctgacattctccactgaatgggttaaaaaggaatgtaaaactacaaaatacttaagtgtgagttctaaattatggcaaacagaacaataaataccttgccatttttctttctaattttccaagatagatttcattataaaaattgtttgataacaatttaagaagggaaaacaagggatactcataaaaaacattttactttaattatagggtacaaataagagtcttaacacagaaatcctacctcctatttaagatataaatacttgatgatataatcaatcaagaggga

SEQ ID NO: 1370 - DNA, 430 bp, Homo sapiens
  Genbank Accession No. AA489636
atattaaaagactttattcacaatagagaaattttacaaatataatttttaaaaattatgtgtcaatctattgtttcccataacattggagatttatatataaagttgaaaatgacagaatggatttatgtaaaaataaaaaacaatcaatgtacacaatgtgtagctcatatgaaaacctcatgacaagtcattgagttctgtaaactgccatacaacttacatgtgtaatattaattgcacaaagtatatcaagacatattgaagaaacacaaaattaagtgctattttaacggttcatctttcagtatgtgaatacgtatacaaatttaactgcacagttttgttgaaaataagtttcaacaataagacttcagttgttaaaattaacccaaaatataactttaattaaattacatcactacaatat

SEQ ID NO: 1371 - DNA, 459 bp, Homo sapiens
  Genbank Accession No. AA489707
ttttttttttggacaattgtgaacgttgttgttccattctttctttctccaatttcttctgcttttcacgttccattttttcaagaccttcgcgaatccaagcgggaagagtcctgcgttttactgcgtcaatttgtggaggctcctgcttcacaggaagtgcaataggtgaacgctgacgatccctgaatgatgatggcctttctcttcgattctggggaggtgctggaggtcctggaggtcctggttgccaataaggaggatgaaatccaccttgcggtggaccaaaagcagccccatgctgatagtcaaactggttcactggccccactgcaaaattatcgggtggtccaccaaagttgtgattgttctggttaaatatatgcctgttgtcaggggcaaattccccactgtcctgactgttgctgtcttcagaaggaggaacaatgtccattgggc

SEQ ID NO: 1372 - DNA, 483 bp, Homo sapiens
  Genbank Accession No. AA489712
tttttttttaaactgtttatactggtttaatccatgtcaaatgtagtttacaaagggaaaggacaagtacctttgtatagaatatacagacacagcatcacaccacagggcccacgggagggtcggggagacgacactttttccctgggaaaggcagctctaatcccaggaatggttctcagcagaggctgggtggccaggagcactgtcctctagccccctaactcagcctctgcttcagctcggttcccatttcctgcctctaccccccaactccttataaagagccccatgagctaagactaaggagaggatcatgtcccttggggcgtgtgccatgtctgggagaagaaatatacaccactgaacaccgagcacatgggagagggaagggacaccacaggagagagagaggcaggtaccccaagaggtggatgggccgagttcccagccaaccctgaaggaggcgctgcttccaggggt

SEQ ID NO: 1373 - DNA, 454 bp, Homo sapiens
  Genbank Accession No. AA489798
taactttttatagtgtttattaaatcaaggaccggttagatagatgatgggctaggcaggtgggggaagacagagctcactgccctgtgggtctctgtggggccagcccctgatgcccatgtggccactgatgcccagcttcccccaacaccccaacacaggcccaggacaatattacaaaagtgaacaaatgcaacctttttctgcttttacaaatgacatgtctccatccccggccagcaggggtaggggaggccggttgaaagtgacactccgttaaaaaggcaacaacttttataaaatgaagactaaggaaacagcccagggttcggaagctgagatgctaccctgggggtgagagcatagacatgggtcgggcagaccttgtctcctttcacggcattcctgggagggtaagaagggctgtcgtgctcagggccagtggggactgaat

SEQ ID NO: 1374 - DNA, 465 bp, Homo sapiens
  Genbank Accession No. AA490159
  unsure (1)..(465): n = a or c or g or t
ttttcagtatcaaatctagttttaatcttctataacaagtcaccttttcttcccacctatatccaactgcgcctagtggtacagtgagaatgatggcctcctctctttccctggagtctgaggtattggcaacagcagtcgcccactgctgagaggacttaggacccagcagaagtcaagggtcattagtgccctgcagctgcaggantagcctcacttcaggtggggatggggtaggatgcgggcaggacagggcctaggaaaagaagaagggtacaggagccttcctgactgcagaagtttcctgtttgtctgaaggcaggaaataggagctaacggagtctaaggccaaaggttatcttttaaatagagcataggatcagggagctgggacctcactagccactgataacttccagcgccacccgggtgagagaaaaggcgcagaaatggaaagtgaaaggt

SEQ ID NO: 1375 - DNA, 437 bp, Homo sapiens
  Genbank Accession No. AA490212
ttaacggtttaacattttactaaatcaactcacacaaattccaaattgcaaatataattaaggacaacagattctgctttgccttattaaatctttcattttcaaatccatcaataagacaaaaagtaaccaaaaattaggtctgttgcaaattcatgattcttctgaggggggaaaccaaaagaacattagagtaaaaagaacgccactggaggatgtacaataaagcaccacaacacacgcttacaaacggggcttcctggcttcggtgacaggtaaaagacgctgttctccccactgctgtgcgtcaatcagggtttcattaaaataaaactataaaatctcctaggttacactaagtcagacacggtctggaacacagtgcttaacaacagtaatgccaactatcagtgctaacataaaaacattttagaagg

SEQ ID NO: 1376 - DNA, 342 bp, Homo sapiens
  Genbank Accession No. AA490214
tcacactgtcacaatttattgaaattttataaaaactcaggccaagtggaagaataaggtacaactcaagagtacaaagacaactccgtttccgttcagtacttttctcctcagcactggtggtaagaaagccccttgctctctagtagccaggcagcatggacttacagtcttaaaatgaggctttatgtatttcaggctggaggcaggttgccttttctcctgaggaatctcaggcagggtaaaagttacttaccactcagtacctctgtgccagaagaaaagctcaatttattcaatccttagaaaagttactatcgtcccctggtcagacactaaggt

SEQ ID NO: 1377 - DNA, 332 bp, Homo sapiens
  Genbank Accession No. AA490494
ttttttttttttaacaaacacctaatgtttattaataaattagtacacttgaaggcatttttctgatatcggtccttcaccactacccacaaaccccacccacacaaagggagtccacgccacctttgcattggaacctggcaactgagcattagaaggtacatttgtaaatgggagcatagttgcaaatatatcagacaagggttcttacagttgcagccatttttaattaaagtaattggtgaaggaatcccaccaggaccaaggccttgagagcagattggacctattgattatgtgtatataaaaaacaagacatcttttaaagcaaa

SEQ ID NO: 1378 - DNA, 388 bp, Homo sapiens
  Genbank Accession No. AA490620
ttttttttttttttttttttttcagaatccaaaaggactttattttctggcactgggaggcgccctgaggccacagccttttcccagggctgctggcagggtcccagggctgctggcaggggttgtggtcctgttgagcagaggagcgacgccgctgccctggcccccgctgtccctatgatcctgcactctggggtgggagctacatatcatccttggacaccaggcagtagaagtctgtgcgggcactgtagtttcgcgagccgagatccgagacgtccacttcgctgctccggctctctcccagcgagaccccactggtgtgcggtggagctgatggctctccaaaaacaggcccccggacacccaggtcgccctcagggtccgg

SEQ ID NO: 1379 - DNA, 493 bp, Homo sapiens
  Genbank Accession No. AA490670
ttttttttttttaagattttcaaaatatttttatatagaaattttttacaaagattttacaacatagcaaatcattatgtcatactgtagaaagatgaagcaaaggattaaactccaaggataaagaaagtgctcatagcaacgtattgcagtctccatgaaagtgcatataaacggttaaggcaaagtaccatcttggtacagacatgttgcaaactgacttttaaaacaattttttaaaatatatacaaactttttttcttctattcttctcaaaggcatttgaaagggatacttttatgaatattcttgctgtagaacaatgtagaaataacttctgggtataaaacagtaaaaataaaaatattctacctgagtgtgttaaatccagtgatttgtaaaacaaaaccttcacaagtgtgggctttctacatgtaacttgccaggctgaaggcttacaccctcatgttctacaacacagatcactaatgat

SEQ ID NO: 1380 - DNA, 312 bp, Homo sapiens
  Genbank Accession No. AA490775
gctgggattacaggtgtaagccatcacacctggccctagtgacaggtttttatgggtacttttagatgatctaagaaatcatgtgcatatatctttcagatttttattttgggaaaatgtaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagct

SEQ ID NO: 1381 - DNA, 233 bp, Homo sapiens
  Genbank Accession No. AA490882
tttttttttcataatgctaatgcaagagggcttgaagtatcaaagagtccacaggaaatggatgcccccagtaatatcttttttttaaaaaaaatatacattatataatatatattatatatataaaaagctagtgtaaatgcttccatggtgtggtcacaaatttgaaagatgaacctcctttcagctgttaaccatcttcccatttgcaacaggttttaaaaagtcgtttt

SEQ ID NO: 1382 - DNA, 405 bp, Homo sapiens
  Genbank Accession No. AA490890
ttttttttgaaaataggagattccagtctacccgaatcagtgtaatacggaaatgctcactgttttaacccttaaaagaaaagtaatctgatgttaaccaatcagcattttttcctgttacagttctcaccttacaaaacccactgctttgccactgcccagtgagacctctcattctattttgtagaatggaggctgatccgattcatgcatcttgaataaaagccaattagatctatgattaaatttgttgtaattttgtcttttgacaacatgtatattaaaagtactcaatctggttgttattgtttttgatagaaaaaataactatgctacacttatccacagtccttggtcagccaacttcaggctcaaatatgtcacattacattctacaacttgctt

SEQ ID NO: 1383 - DNA, 253 bp, Homo sapiens
  Genbank Accession No. AA490947
tttttttttttttttttttttttttgcagaaccttgaaataaaacatgttttacagtaagttcacacacaggcttaatgcgaaccagagtaatgcacagatgattgccaagaccatattgacaaattgtgattagattataacgcatagtagcctgccttacattcagcaagttcaaacaggacacaaaaccagtcaactgaacacagagcagctctcttcagaagcacttccaatgagtgatgcagagattt

SEQ ID NO: 1384 - DNA, 361 bp, Homo sapiens
  Genbank Accession No. AA490964
tttttttttttgtaaatgatgactcaatctatctcccaagcaccaatcctgaagggaatgctgaatctgaatgcccccataggtggaacttcaaactctcaatgttcaaaacaacatcgctttttcttcacaaaatcttcattatgtatttgatggaaccaatatccttgaaataacataaattccaagcttagggtacctttgacgtataggggataaaagaaagggaacagtcaatcagatgctaagttctcttagttttacttttcttgtttctctccagtgcaaatagcaagcaatacacatagcaagtgctgaataagtgcttttggaatgtgtattctaatttctgaacctttcc

SEQ ID NO: 1385 - DNA, 448 bp, Homo sapiens
  Genbank Accession No. AA491000
tttctcttcttttttttaacatcatcaaatactttatttaacaacagtttgtttaccaagttaggacactggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtc

SEQ ID NO: 1386 - DNA, 422 bp, Homo sapiens
  Genbank Accession No. AA491001
tttttttttttttttttttttttttttttttttttttttgagcccgctagtttattcaatactaggaataagccggtataaaatacatttttagaaaattcacttggagataaaaaatcttgtccccactcctcccccaatcccaaaaatctgtgctcttctgcctgagttaattcagctttgctgagcctcctgcaagagcttgagcagggggtcgtcagccctgagggaaaaggtgagcgtgcgctgctggtagtgcctagggtcacactccaagttctcgatcacctcagccagcaggtgggcccgttcaggcctgagccgggggcctcgaagcccagggcggtgaagtgcacatgcaggtggtagtaggagggcaggtagtgcaggtatactcgcagatggtctcccttcatccggta

SEQ ID NO: 1387 - DNA, 451 bp, Homo sapiens
  Genbank Accession No. AA491188
  unsure (1)..(451): n = a or c or g or t
agaattaacttctacaagaaaacatacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaatttttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagtntcccctgctggtt

SEQ ID NO: 1388 - DNA, 155 bp, Homo sapiens
  Genbank Accession No. AA491208
ttttttttttttttttttttttttttttttttttttttagccacaaaacattttatttacaaaatatatactgaatactatacatctggccccatcaccatggaaacaactccaaagcctgcctggggatttgtgcccaagcccagcccaggagg

SEQ ID NO: 1389 - DNA, 443 bp, Homo sapiens
  Genbank Accession No. AA491223
tttttttttgtaagcaggtgatggttttattggcaaacttataggggtagtgtatgaagtcatttcaaataacagattaagttgctttccttacaactaaaagcttcaattactacatttcaactttaatttaacatcacatctacatgtgaagctttaatttcaggtctggagcagctgtaaaatgaaagttaccactccattctagtccttggatatcagtatattccccttcaccttccaccctattttcattgaaatttccagtatactttgccccatttgggaatgtgtaagtccccagtccatgaaacatattatccttaaattgtccttcatatactgctcctgaaaaatgctcaagtcttccaaaaccattcatcttgtcatctttccagcttcctgtgtagacaatcccattaggagtggtatgaatacctatt

SEQ ID NO: 1390 - DNA, 529 bp, Homo sapiens
  Genbank Accession No. AA491295
tttttttttgtcccctttaaaacaacaaaggaaaaaacaaataaccagagatgacgatcgaggctctacacacgtgctgggtttccgtaggacatgctgctatggaaacgcggtgcagcagccccccagaggcgacgcggcgcgcatgcgaggtcgagcgatccaggcagctactcgggctccatggcctcctccggccgcagtggatgcatgcgtgcgggggagccgggggcgggggcccagcaactttccacgcagggactgcctctcacaagagcacttcctcctcccccacggggggcgggtcggtgccctggaggttgtcttcgctgccttgcttcgtgagcaagtttccaggcgctgacagtgagcgttcctcccgccggctgccctcgaatgggttcccaaaggagcgtttacgtatcatggtcttcaccaggatcacggttgccaagctgggaatgtgtttgactgagttctcgacctcctcttcagtcacttcgaccagcgtgcagttctcatcctccga

SEQ ID NO: 1391 - DNA, 296 bp, Homo sapiens
  Genbank Accession No. AA495758
acgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaa

SEQ ID NO: 1392 - DNA, 501 bp, Homo sapiens
  Genbank Accession No. AA495803
attatagtatagtttatttaatacaatgtttaactataaaagttaatacagcttccaagtttcaattttgtaaaatgcagtttgcagaaaagttcaacaattactagactaatgataagagaagcagcattttgaaactaattttacaattgagaagacaacagctttttttctaaacttcattaaaaaaatataatcacagtgacttttgggctaggaaaagaagtgcattaacttcatttatgttttttccttccacaaagagagcggccacaattttgtacatcccacatacaaatacccaattcatttatctttcaaaatactatatacacacaaaaggggaagaaaatatacagcatgtgcttttggtaacatatggaatttgcttaaagaaaaaaagtcagaaacacaaatccaccccaccactccctcacataccttttaaaacaaactaaacccctcaacaactccctactccaaccttgttgacggaatttc

SEQ ID NO: 1393 - DNA, 490 bp, Homo sapiens
  Genbank Accession No. AA495820
ggaccgccagcctgggtccgcgcagccaccgatctgggcgcccacaagcggccggcatccgtgtcgagcagcgtgccgtggagcacgagcactgaggcggcacgaaggagaaacaaccgccgccgcctgcgcaccggggcccgccgacagcctgtccaccgctgccggggccgccgagctgagccggaaggtgcgggcaagagccgcgggtctggagagcaggactgggtcaacaggcccaagaccgtgcgcgacacgctgctggcgctgcaccagcacggccactcggggcacttcgagagcaagtttaagaaggagccggccctgactgcagttgcaagaacagcaaggaaaaggaagccctctccagaaccagaaggtgaagtcgggccccctaagatcaacggagaggcccagccgtgctgtccacatccacagaggggctcaagatccccatgactcctacatcctcttttgtgtctccgccacc

SEQ ID NO: 1394 - DNA, 377 bp, Homo sapiens
  Genbank Accession No. AA495857
gaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttaaaa

SEQ ID NO: 1395 - DNA, 385 bp, Homo sapiens
  Genbank Accession No. AA495924
taggaactacagtgttatctgtcattttcatgcgaatttttttcattaatttgtgactttacatagactatttcttaaattataggtacaccaatagctggtgctggggaaggatgtttaagcaacatgctttctcttctctgcagactctaaaatagcattgccagtgcacgacattcataatttaaaatgtatgcagacactgaaatgtataaaaagcagaatataagaaaataaaatttattaaaattatttatattaaaaaatgaagtatatgaagatctctcagtaataaaagtacaaaaagctactctttgcaatatgaaaaattgaggtattgcataaagagatatcccgtcagtgaaaagtgtgcctaaaaatgttc

SEQ ID NO: 1396 - DNA, 501 bp, Homo sapiens
  Genbank Accession No. AA496053
ttttagctcacgaaagaagttccaggatatggctataacaacaaactaatcttggtgatatctgtgactgtaatactaacgattttgattctaattttttgtcttattgaggtaaggacaataattaattcaggttttcagaaagcaatcctgtctttgtgtggattcagaacccacaaactgaaaaccaaagccacttccccacttgacattcttcttcagtcgtttaaggctgaggtatgctttgttcttttactgcagtgtatattccaggatttttaaaggatcctcgcttccaagagatctcaagtcacccttactctgccactaatttatttccttgttgctgaaatgatgagagatgtataatctccaccctcacggagttgtcatcaccctggcaacccctccgtagtcaaggccttcttctccatgaaattttatcattaatcgcttccagagatcttttggtctcattttcatgacctgtcaatatgattc

SEQ ID NO: 1397 - DNA, 472 bp, Homo sapiens
  Genbank Accession No. AA496204
ttttttttttttttttttttttttttttttttttttttttttgggcaggtactattctttttatttgatagacaaggaagctgaagtgcagaacgattaatttgagtaatgtcatttagcttgcaagtgtcaaagatggcatttgaacccagacagcctggctccaccatctggactcttacagccttcaatctctaagagggggaaggaacttacatgacatcctactgggaatttgctagaaaccagatctctctgccctgcggcaaaaggtacaacagggaaacacgagaatgggtctcagaggcacccctggtacccccgtcatcacctgctgagacagagagcctccctggccatccaggaataatctagaagttatcgcccaaaaccattttactgggagaacaaacaccaggaggctaccttctagaggctgctgggcctcagacctcaagaagtggaggcctca

SEQ ID NO: 1398 - DNA, 476 bp, Homo sapiens
  Genbank Accession No. AA496245
ttttaaggtttgcatgtttatttataattacaatttacattactccaacagaggagcccccttgctatgttctaattcttagccattaagtcctacaaaaataaacccaagcttttacagtaacttaatcaatacagaactaaagcctttatagctattagaggggtttagttaccaaggtgcttattttcgacaaaatgccctgtcactcagaggacgcatgcgtatactaaagttctgacccatcgactcatgcaacaaatgtagaccccaccctccctccacccactgttacaacacaaacacaaaacaacgatgtacaacagaggggaaatatgctcttggtcaactgaccttgcagaaaagactggcttgtttccaagtggatgagaacgccagtgtgtggccagagtccagcaatgactgaccggcccaggtcagaggctggcagggaccacagaagggccaaggcgctg

SEQ ID NO: 1399 - DNA, 491 bp, Homo sapiens
  Genbank Accession No. AA496423
tcggcacaggctgggtcatgttgttgccaccctgtgtgacttttgaagctgtaaaatgtgcttccagggcttgggtggcgtcggggcagggcgccgaggcttggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaagagaaggttaattttaagagaattccctatttatttgacaaaaaatccagttaatatattaatgtgaaataaaccctgtttgcacctcgatttgtttgctgaaaatgtgaaatagt

SEQ ID NO: 1400 - DNA, 421 bp, Homo sapiens
  Genbank Accession No. AA496715
ttgcaataaatcattatcttttattttttttaaagcaaatcagtgaaggaaaggacaaaaacctttggttcacttatgtatttatgaatggaaaaagtttataatgcaaatttcactcattaaaaaacttaggtacaaattacaacattacagataattctctttttgctgcttttgtttcacatggagaccttggagactcaattcacgttaagacacctaaggtacgagtcctccaggtaaatattacacaaatgggaagcatcttgaatttttaagtatatttcaatacataaatttttatgcatgctttaaacaaacagtattttttttaaatgagagaatctaacaaaaaaagtctgaccagcaccagcatttaaattttctgattttaatattagtctgacatagcgttagtaac

SEQ ID NO: 1401 - DNA, 379 bp, Homo sapiens
  Genbank Accession No. AA496914
tttttttttttttttcaaaaaaaaatgccgtttattattgtagattattcttttcttgatataaccagaattgaaaatgaaagaaaagcacataggaacaacacgcgtggttagttagtaactcaagatataaaacaattttgcacagcaaaatatgtaaaagaaaagtaactgacaagatttttttatatttattgtggtaagatttacttttcatttctttttaaagacaggatgtcagtccctgaaaataacatttactgattattgcctttaaaactgtggatttttttttaagttacagaaaatccagttctgcaccacaatacaactgtaaaaaaatctgcatcatcttaaaactgtgcagtaatgccatttt

SEQ ID NO: 1402 - DNA, 374 bp, Homo sapiens
  Genbank Accession No. AA496927
cttttgttctcaacttgtttaatatggaaaaaggtcatcaaaacggtaggcagggttgctgtttttaatacattcttgggatgttggccattcagacagcattatttcaaatatagatgagttatccaactttttttgactcaaagatagtttgcttagattttttttttttgagatggagtcttgctctgtcaccaggctggagtgtagtggcgtgatctcagctcaccgcaacctccgcctcccaggttcaagcaattctcctacctcagcctcccaagtagctgggactacaggcatgcaccaccacacccagctaatttttgtatttttagtagagacagggtttcaccatgttggccaggatggtctcg

SEQ ID NO: 1403 - DNA, 363 bp, Homo sapiens
  Genbank Accession No. AA496936
tttctggttaaaagcactttattgattacagtatcaattcacaacatttcataaagccactgtacaaatagaggaatgaatcactgtgtaagaaagatctaagaacagttaaatcatgatacaagtccatagtttatatggtttagagctttaagagccttaatctaacacgtttacccttcccataattagactactactgacattcatgttcagttgaccacgagtgtgtacaaatcattctaggtaaagacaaacactttcagaatgctttaacagaaaaataattttaatcaactttaaaaacacacttagatgtggatgcctttggataggaaaatagaaatgcaagtgttcagatgc

SEQ ID NO: 1404 - DNA, 472 bp, Homo sapiens
  Genbank Accession No. AA496981
aaactttggcatttttattcagacacgtataaaaacaaaacaaaaaacttcagtgatacaacagacgttttcccttagttccccatccaaggggacagaggtgtgcagctgaagctggatcttttttctgtcctacctggaagcttctcactgctggatgagaatggcttctaaaagtggatcttggggatccttgtgaatttgccctcggataaggagtgaagatcatttacggcacatgtggattatggtttacacaaagatgtccagttatttttccttctgactacccccaccaccacttcctgagatgagatgtctaggtataggaggatgtggctgttggggttagacttgattcagtgcaaaaacaagaaacagtgccccttaaacaagggctgtaacttaaatcagtttttcttggcaccttacaataagagcacatgcacaggaattgggaggattttgcatc

SEQ ID NO: 1405 - DNA, 451 bp, Homo sapiens
  Genbank Accession No. AA496993
ttttaatataaaatgtttttaattgtttttgaaaacatttaaaaaacaatttttgagcactttaataaaaaaagagaactgaaatgctaccgcaatattcaactactgtagtttcagcaggtacaacagacaacaaaacactggggaaatctgactttttgcactaaatgaaacatgaaacagggcttgtttttgtcatttatcgtgtagtaaagcacattatagtacaagactattatatgaacctcagaagcactgcacaaaaaaacactttccttcttttcagttcaaaagtcagtgcttattgcaattatatgcaaaattatttacttcatgaagttttatgataaacagtatgcaaaatgttttaaacatccaaacaataaaaataatctggaacagaacatattcaacaataactaagcagaattagtaaacataaagtaaataa

SEQ ID NO: 1406 - DNA, 273 bp, Homo sapiens
  Genbank Accession No. AA497018
ttttttttttttttttttttttaccatccagtcaagtttattaaaaaaatacagacacacaaacttaagaaactggaaggaacaaaatgttcatgatagcttttttgtgagatggtaggattccagataaatgcttttcattttctcccttgtgcatctttgtgttctccatattttccataatcaattatgtttacgatcaggagagagtgctgagagaagaacagagctggcgtgaatgccctgggggataagggctgatggcaggagctc

SEQ ID NO: 1407 - DNA, 252 bp, Homo sapiens
  Genbank Accession No. AA497031
cacaggaataataaatttattataatcacagatggtggggtagtgcacataaaaaggggggacctcttctcaccagagggtgctggccggtgcccagagtggcaggcaacatagggaggcgctccctgcatggcccggcccgctgccaggcccgctgtctctgggtgctcagtgtgtggtgctctgaggacacgggtcctgagggccttgctcttcatccttcacagtggggacacggccctcatgccagcg

SEQ ID NO: 1408 - DNA, 297 bp, Homo sapiens
  Genbank Accession No. AA497052
agattcacactttcttattttttattttattttttttacaaatagaaatacatcccttttcaatttttattttttatttcatgtcactgttttgtctttttttttttaaactacacgagcagaacatgcagctatgtgtgtgcgctgatattgtttaaaggtaatacttattctcggaaggcaaggcacatcttgtggtagaaaatttcgtgcaaattaggaaacatggaatttttttaaaggtttttcttgtatctttttttttttttttttttttttaaagaggaagtggggggt

SEQ ID NO: 1409 - DNA, 446 bp, Homo sapiens
  Genbank Accession No. AA504111
ttttttttttttttaaaagcaaactaactttatttgaataatctaaatagagaacaagggtaggtgaatgtgtagccagagggaaaatatcctatgtcaagtttcaaaacataacaagcaaaaataagtttatttctaaaagaaatttcagtgaaagaaaaaggatgtttattatgacataatatattgattcctaatggtggatctattaactgtttgtctaatctagtcaaaatatttaagctgtttctgcatatgtaaataaggcttaaaaattagagaacaaaatctgttctctaattttacctagtaaaataatggtaaagcaataaactaaatttacaaaggtttcatagatatgcctatcacaagtttaaaataaaaacaatcaggagagaagcatgtcaacaatgtgtaatttaatttcaacaatgtgtaatttaaac

SEQ ID NO: 1410 - DNA, 331 bp, Homo sapiens
  Genbank Accession No. AA504264
tttttttttttttttttttttttttttttttttgtgttccaataaaattttatttatggacactgaaatttgaatttcacataattctcacgtgtcacaaaataattcttttgattcttttccaaccatttaaaaaatgtaaagaacattcttagctctcaggctacacaaaaatatggctatactttgtcaaccatccctagaccctgaacagcatttctgaattagtaacacttaggtgtcctaaaaaacaggtttgggatagctgtgtgttaaggagtccctaaaaaattcataatgccaattagcataataaaggctctaagccttg

SEQ ID NO: 1411 - DNA, 538 bp, Homo sapiens
  Genbank Accession No. AA504270
tttttttttttttttttttagtaaaacaaaatttatttgtaaaacaggacctgttatataaaatggcacacaatcaagttatacaaaaatacaaaatttctttctgattacagttctagttgcaaatgataattagaaagcattcctggtagcttccaaatagctgagattgcgagcatatggaacagggagcagcaacagtccatgatgcagggatgtccaagtgagtagaacctaatttccaagttcaggacttccatcaggtcactttggagggacacctcttaaaattgctagctcctggaatgtcttctgttttgatacccatcttctagacttttgccaattctaaatttagttcccaatgtttgtgaaagtccaaaatctgtgcggctatgaaacagatggtattctgaattttctcacatgatttgctctctcatctatttggacaattgttagttatataattatattcatttcaaatgaataaaagagaacagcgatactgtttggtgatactagatattagatgtta

SEQ ID NO: 1412 - DNA, 541 bp, Homo sapiens
  Genbank Accession No. AA504324
tttttttttttttttttttttttttttttttaaatcaaacactttatttccacataacaagcgcaaaaaactcccaaacactttaacaatacaattaacgcattatgaattatatactactcaaagccccaaggtcagaaggtcaatcagcttaacgctccaaacatttccagacatggtttttcaaagctacctttggtttttggaaaaaccagtatggaagtcaatatacattgaacgcactgaataacatttgcttatagtaaggtgtccgacaacattagctcacacctggcaagttggagcatgatctgaagtcatacactgaaatccatacacaggtttcgcccccgagctcctgcagggagaagcgagggccgtgaagggggaagaaaaggccagtccgggtgtggcgtttctcgctttgtaacagaggtatgagagtttaacactagtacactgtcaagtcattaagcttcatgttccacatggtttcttgctgaggcttgagatgggcacaaatggtggggaagatgaagtc

SEQ ID NO: 1413 - DNA, 452 bp, Homo sapiens
  Genbank Accession No. AA504413
tgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttctgaagtgttctttgccatttctggaattgtccttggtttttccttagctcataggtcatagatgcagaaatatagtatttaaggcatccgcatccagcatcagatggctttgcatccagaaaaacattgataactcagtttgaagc

SEQ ID NO: 1414 - DNA, 287 bp, Homo sapiens
  Genbank Accession No. AA504492
tttttttttttttttttttttgaagggcatgatagtttatttttaaaaattgtaccacactgatcatgatgaccagcatacacatgataatggcttttctcttgggtttaacattgcagtagttttgcatactgcaatgtttcaataggaccaagaacgttagagaataaagatcttagatgaaaatgaacactaataattctagtgtcctcccccatagaattaatgtaaatcccgtatgaatcagtggcattataatgttatgtggttatgaagaatgaaatttc

SEQ ID NO: 1415 - DNA, 382 bp, Homo sapiens
  Genbank Accession No. AA504512
tttttttttttttttctgacaacttcaaacaggactttaattccaaaccaaccacagaaccggcgcctgggagcaagtgggactgaggcccaggtgctaacacggggctggcagtgtcgagagaacactctggaagctcctaacagacggctccgcgtgcggatgcacaggccctgacgggcactctgagctgggcagtctgacaccaagcagtaaggcctcccgggcagcgcacgctcagtccacgagcacagcgggtggccctctggggggaggcagcacggggcgcactacggcaaggcgagcgggcgggatggatgaaacgcagcggcaccaggagccccaggctctcacaggtgccacccccgaccccaggattttc

SEQ ID NO: 1416 - DNA, 421 bp, Homo sapiens
  Genbank Accession No. AA504806
ttttttttttttttttttttttttttatttttaaactactgtttaatcagttgtaaagacacacaaattagaaaaaaaaacatgtcctaaacatgttacatgtaagttaaaaacacctttaaaaaccagcaataagccaccagtgcagctctgacagactagaaatgagtggttatgaaatgagcacatctcagtttgactgacacagtgggagttttaatttaccgtacatcaggaactaatttatgaatctgttgaaaaataacacttctttaaaaaaatattttggaataataaaaacagaaagcacagaacaccacattctattctcaacttgggaaggcaaatgtaaatactaaattctggctgctggagttgggtctctcctcatgtttgggcgactgagggctcaactactact

SEQ ID NO: 1417 - DNA, 418 bp, Homo sapiens
  Genbank Accession No. AA505133
ttttttttttttttttttttttttttttttttgacaatgagaaaaaattttatttatgacgatcttgagcagtataaaactcagaagctccactgaggtgaaggaaacatggacatgatactaagcaaagcctagtcttttccataaaatgaataagaagtacatttggtggagtttgagaccagcctgggcaacacagtgagaccctgtctctaaaagcattaaagcattaatcctcgcatttcgatagggctatgtagcttttaagtaagcaatgttagaatgagttgtagagttttatttttgtgaatatagtgagtgacagatggcaattacatgaggatatttgaacgaaggtacataagcctaaacaatttcacctaggtaaaatattgatgtcataaccaaactatatggc

SEQ ID NO: 1418 - DNA, 454 bp, Homo sapiens
  Genbank Accession No. AA505141
ttttttttttttttttttttttttttttttttgcagacacagacatcatgtgaggtatttattttgcagccattcagttcagctgtccagtatcaggttaccaaagacaaattttcaagctcccggttaatccccaccaaagtttctactgttcggctacttcaggatggctaacatttggagagaagaggatcccccaggtagtctgtacataattcagagagaggacatcagaattttccatggttctatttcaggtattaaggtaccacagtgaagcatgtcatttgactgtggtggcaaagggacggcactgagcatgcctaacctattccccggcatttcagtccaatcagcgcatgctcgcaatgatcatccatgggtgaaaaggaagagctgaaagacacatgtgctgagcaacatttaatttctgcttgttaaacgggtgattagg

SEQ ID NO: 1419 - DNA, 489 bp, Homo sapiens
  Genbank Accession No. AA505198
gcacgaggatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagt

SEQ ID NO: 1420 - DNA, 558 bp, Homo sapiens
  Genbank Accession No. AA521149
tttttttttaacataactgtggacatataaacatttaataaatcagcacacaactgtgatggtgattgatcctttgacacgcacgctctgtgtggacgacacgtgctcccagcatggtaggggaatgacctacgtggctgacttcggaactgaagactccccatatatgcacactgaacacttgcgtgcagacgtcccgaataccgcagtcttagccaggcaggggtgaatggagggaacagagcagctccttccagcctctgggcaagcagagtgcttcctttttccagccccaggcatcgccttccctagacacggttttctctctgtgtgttctctcattctttccagcaacagcacagacagagctcagactggctgtgtgtggggtggccacaagacagcgagcctgcttgcgctgccgttgtgctgtgtgatccccggccagcccttggccctttcctcacttctgctagagagctggtgctgctcttggagaagcctgcgcaggacgaggtggaccacccgatggtctctcggcactgtgtccagcatttc

SEQ ID NO: 1421 - DNA, 601 bp, Homo sapiens
  Genbank Accession No. AA521290
ttttttttttttttttttttttttttttttttttttttttgagcttggcaaaccttttttattttgtgataaaaatgctttcatataaatttcatcttaactacctttagaatgaaacggaaaagtaaaaacaaagtgtgcattttccttactacgtttagtcaggaatatgcggtcattttattggttactgggtttctcatacaaacagatataatatcacttttaagagaaatgtacacaaggaagtaaccatagtaccacttattagtgggggcctctgggtacataaatgtgtcctcccaaatagtcatcatacattcaatgtattggttagggccaaaatccctaaaccacctctcaacaaaacattacacctttggtcctttattatgcaaaaattacaaattggcaaattcaataagaggatgcaatggatttgagcatcacagccaattgcttatactaaaatattttaattctcagactctctttccctcatacctttcccttccccacctcacataagaaaatgatgcttaaaacaaaacagaggaagcaattatacaaacaaaaaaacctatccccaaaggcgggcaga

SEQ ID NO: 1422 - DNA, 601 bp, Homo sapiens
  Genbank Accession No. AA521292
ttttttttttttttttttttttccttttaatgaaaatgatttaacttagaaatctgttgtgaaacttttgtctagttttgcaattctcagatattccagtgcaaaaatagatcccattacagacagcgtaaagtgcttggaatgagggccaatgatgaacaaagagcacaaaaacagcttcatcttagggtataagaagggataatagcatacctaaatccttatggaaatagaaacattctaagggggatgcaacaattttgaaaagaattagagcaatatttctacagtattacattattactagtagataataacaagggtacaaattaatgtctcaatatcaaagtggttcagtattacatgacacatggctctttggaaaatattttacctgatatatacaaccacaagaagaaaacacagacaaatggctttagtcaatgattactatacagtgaatgaatgatgtgcaacatttaatagtcacaaagcatttgctttcagtacagataatgaaatacagtagtgtgaggtttggttgttttttaacaatgaattgtgctgggcatttatgtatagagggcttattattttcttc

SEQ ID NO: 1423 - DNA, 602 bp, Homo sapiens
  Genbank Accession No. AA521306
tttttttttcgggtgaatcactttaatgctgttaacggcaagtctgtaaaaggttcaggacaaagttcttttttctttcttttttaattataaaactaacagctgttagaatctttttttctttttttccttttttcttttcccagctacaaaatactctggggagatgcattataatttaaaatatataatattgcacaaacaaccaaaaggttaattaaactaaagaaataattacaaagagaaaaaccccatcccgtcaaaaaaaagattcagcattctctccatcccaccccctcactgaaggtttgaagtggaagtgacctcactctcttggtgtccctgacccacgatccctttcactcattggtgagcacaccagattaggtacaagaatcaccaaagcagcatcgtgaagcaccaggctctccagagattcctgcagcccctcattcccccagaggtgcagctttaccagagtggagggtgagagcacaaaggctgggtctgtcttcaggaagaagagcttttgcagaagcctgatgagagtttcaagttcacccccaggatagcccttccagaagcagaagggctgaggcgga

SEQ ID NO: 1424 - DNA, 318 bp, Homo sapiens
  Genbank Accession No. AA598405
gagtcaggttctcactgtgccaccaaggttgtagtgccgtggtgtaatcatggctcattgcagccttgaacttctgggctcaagtgatcctcccacctcaacctcctgagtagctgggaatacaggcatgcaccaccatgcctaattttttagagatggggtcttgctatattgcccagtctggcctcaagtaatcctcctgcctcagctttctgaattgctgggattatcggcatgagccactgtgcccagctaagctgtgacttttgaggcaaccccttcccttccacagagtttagtttcctcatttgtaaaatg

SEQ ID NO: 1425 - DNA, 434 bp, Homo sapiens
  Genbank Accession No. AA598412
tttttttttttttaagtccattacagtgcacatttattgactctgtgtatcttcacagtgtgatcttcaccacagcttgcaaagtgtaaccactcagcaccttctgcttccttctgttcagtttttccactgcaattcttccagcataattttctgatagccagtgtatgactttggctttgacttgtttctacacagtgggtccagtcatttatttctggaacttgatcagtctttttccaggtatataagcaaatctttccacactccaatcctactgcaaccacgtatcgttgagaagggtggagcactgggcagacgctgacagctgtcacagccccacccacgtccaggactgaggagcaggggccaatgttgtgctcaatacagtcatcagtggagtcacactcaccccagacaaccacctttttgtc

SEQ ID NO: 1426 - DNA, 418 bp, Homo sapiens
  Genbank Accession No. AA598417
tcaacaaggaaatgtatttattttttctttagaatttggctcagaacagtaacaaaaatatttacattaaaataaattaacatgcaattacttaaccatatgtaataatttacgttggaatatattagccttcccatgagtttaataaaaactaatatttggttttagattcaataccatcctttcaaatatttggtatgaaacttggtagcaatgcaattgtctgatgtacagagcagatttcaccatgagagattacaccaaagaacagatgtcccttcccagaacattatctcaccccagactcagaaactgagcagccaagcttccttcccaggaatcaccatggaatgtctgaacaataaccaggccctggagattactgcagggctggcagagttttaggaatcagccaaac

SEQ ID NO: 1427 - DNA, 436 bp, Homo sapiens
  Genbank Accession No. AA598419
taaaggaaatctgcctattttatttccattagaaaaatattatctatataacattttgttccactatcttctccttgatctcaaatttaaacactttaattttactcaagtaaaagcagaatcacataacggacatcaaaactaaatagttcacatcattagtttaaattaaatatgttcttgattatttctcaggaatagtaactcttctttcctacctggtatttctcttttgtttactgagtaactatgtaatgggtatctctttcctatattcagtaatacaggtgcacacaggtgtaatttaaaaaagtaactggattccttctctaatattcatgttcaactctccctattacatggtatttccataatagcttcagatattttcatcaaactcacactgtcatcaattgtgaaaattaaaaggttaatt

SEQ ID NO: 1428 - DNA, 384 bp, Homo sapiens
  Genbank Accession No. AA598447
atttggaccggcatgcaggcaacttcttttgttgttacatacctgtattaggaaaattacacccattttacagaaaaatcccaaaacatatactgcaataagctcaaaacaatgtgaaaaagaccagtgtgaatggcacacaaaaatcgcctctttataaattaactggaattcatgatcatgaagtaggcacagggaaatccagtcctcagggctttgctctctggaagaacacctttaagtaatttttaaaaactttagcatcaggctgctgaagcgcttgacaaaactcctgaattatttctggagctacttgcaaggagggcaggtattcttgttgaagatactgaacacattctgggccccgtttgagatgaattgttt

SEQ ID NO: 1429 - DNA, 320 bp, Homo sapiens
  Genbank Accession No. AA598453
ttaaattaagagacagggtgtctcaatgttgcccaagctggagttcagtagctagtggctattcacaagaacgatcatcgcacactacctcaaactcctgggatcaagcaatcctcctgcctcagctttccaagtcgctgggactataagtgtgtaccacagcatgtcagctctctctctccttcttgacctaaagcctagcataaaattagctaagtagaatgtttccaaagatggctgcatcagtatctcccatcccacataatttctgtttcattttgccattcacccataaaatggtgggatctacctccccccct

SEQ ID NO: 1430 - DNA, 268 bp, Homo sapiens
  Genbank Accession No. AA598506
ttttggagggcaaagactttttttaattggacttggctttgacgagtactgacaaaccctgcagacactagtacaatttgatcgtaaacaaagtccttgctagcatagtccagcaaattctgataaaacacatacaaaacttaaaagacagctcgatttcatcttcctcccaacacctgcaactgtttccagattttctgtgtagtcttctttgtgctttcagttcagtaaaaattagaaaggataacaaacttgtaaagtcagatac

SEQ ID NO: 1431 - DNA, 370 bp, Homo sapiens
  Genbank Accession No. AA598589
ctttaaaaaatacacacatttaatgttggtctgttttaatttctaagtaaagcaattccaaaaatacaaactgaacatcagagccatgtgaaccaccatgagaaaataaaacagacattcacaataattacgtctaaagacagttcagctggataaatcatcttccaagtatgttaaagaaaaatttctaaaaatactgctggtgttcagttagaattaaaggactttggggaaaatgaaataatatgatacaggtggagtgaataaggatacacgggatttacatttttcattacccctagatataaacaaacattcaaaaatcaacacaaactctgtgtgttattcaaaatattgcagctgcaggaaa

SEQ ID NO: 1432 - DNA, 484 bp, Homo sapiens
  Genbank Accession No. AA598648
tcttctttttctccttggcgacctgggcagccttgtgctgcgcaccagctccgtgaggttagcctcgtactcgtctgtctgctgcaagaggtaggccaggcgcttgtccttcttctggtcgatgagcttgcgatacccctcctcatcttcagccatgagcctccgcatgcgctccttctcgatccgctcgttctctttcttctgctcccgctccgtgttggcatggtacgtggccactgacttggtcagcttctggattttgcctgtgacggatctgtgatattccttgaaatccttggcatgctggagaatgctattgaggtattcctggtgcttctgccggcgcttgcgtcctggctcgatcttctgctgcttctccagcttctcagtgatgcgggcctcgcgcgggactggcgcttgctgccttgtaggccttagaattgagggctgtctacagcgctgtgtacctccgcatgcacaccac

SEQ ID NO: 1433 - DNA, 381 bp, Homo sapiens
  Genbank Accession No. AA598675
tatttttttgcacatcccttttcactttacagtacatttgactatagtgcacaacatgattccgagtcaaaacagtggcccattggcactgagcttctgattggtgtagggcagtccaatcagtgctggtgtcactgggttaccccaaccatgtccggccaaaatggcactacccagtggtagtgaaccatctaattaaaaccaaaactcccccagggaaaatgctacactatcagagtcagtcttgagtcagatctttatttggtgctccatccagatatatttttagtgctttctctttacgaggtgagtatgttacacgatgtccagtcttctggagtcgactgctttcttttttcatcagttcatttctttgctcat

SEQ ID NO: 1434 - DNA, 372 bp, Homo sapiens
  Genbank Accession No. AA598679
gggtgagacagagtctcactctgccgcccacactggagtgcagtggcgtgatctaggctcactgcaacccccatctcccaggttcaagcaattctcctgcctcagtctcccaagtagctgggattacaggcgtgtgccaccatgcccagctaattttttgtatttttagtagagatgaggtttcaccgtgttggacaaacagctttatttttataaaaatgatgggcaagaagattttaaaaatcaaaagcaattatactttggcctttatgtagtcccagctactcagaaggatgattaagccccagagtttgagtccagcctgggcaacactgcaagaccccatctcaaaaataaaatgatggaagggac

SEQ ID NO: 1435 - DNA, 421 bp, Homo sapiens
  Genbank Accession No. AA598685
attttattggttttttttaaaggaagagattataaaaagacatttcacattaaagatttgcagtcctgggacacagtttggaaaacactatttataaggttgcacatattacaaacagctcccaaatggtgaaactggtattctaagatgaaagcttaatgaacataatgaagtgaataaacgcgtgtgaactaatgtttaaaaagttagagcttgtctcaagtcagtacagctcttaagataataaatacagtaacactactttttatttctttgctcttttatccctttcaggttcgatttgctgctttgattactgtgttagcactggctgaaaaactaaaggagaattatattgtcttgctaccagaatccattcctttcttagcagagttgatggaaggtaattcccaaactattc

SEQ ID NO: 1436 - DNA, 441 bp, Homo sapiens
  Genbank Accession No. AA598712
gactaagcaaaatttgtacttgtttaataagaaaatcacttctttaaaaaaatagttctttacatgctgaggttcatctatgcaatgcaagagctgaaaacagattcgagaaaggctgttcctacaagggaaggtcctgaggttacaacgccggcatggcggaaaacatggctgcagcgatcccagcttcttgctgcccacaggggtggcacatctgggcacacactgtgagctgctcagaggcactctggtgggcagctcccatcgcctcagtcagtgtctccgtccccttcactgccttccaggggactgggcaccttggcgcccgtgccacctgccgtgagagcggtggcactgaagttgtggatgggcaaggtgctcagccactgggccatggagcgttcgtcccgctcggtgccgatgatggtggggtagatgtgc

SEQ ID NO: 1437 - DNA, 374 bp, Homo sapiens
  Genbank Accession No. AA598746
  unsure (1)..(374): n = a or c or g or t
tttttttttttctggtcaaactccctttttattaagggttatcaagctgtacacggtccctaccctgctccgctccgagttcgggcagcgcaattcaccactctcccaaagccggaccacagctgggtgaggggtgggacagagagtaggagcagtcccagcatgcagtgcagcagcccaaagcctcgggcganggcatcgccattcatcccccttcagggcacagcgagatgcgggccagagctcttttgctgggacgtacacagccaaggtcaccctccagcccggtctgtcccatgtgcaggtgatggggggtacgataagcagcaatgagggcccaggaagacctcagtctcctgggggcccatcctaaa

SEQ ID NO: 1438 - DNA, 411 bp, Homo sapiens
  Genbank Accession No. AA598749
ttttttttttttttttttttttttttttttttttttttcttattcatcattcattcatttatttgattagttgaaaacacttccgactaaggaagcagagagcccacaatcctgtgggaaaacaggcctgggaactaatatctcaggggtagtgagggtcgggcccagatcctcaaaggttccctgcccctgaaattgcacctttgacagctgctgaattccaagcacagcgttaagtgctttacatggggtaaccctaaaaaacacactgggcctcagacactcccgtacacacacccaacctctaccctgtggatgtcctagataagggttttctcttcacaaaggtaaatcaactctttgcctccttagggagggaaggaataaaggcattatttttgagacttttct

SEQ ID NO: 1439 - DNA, 511 bp, Homo sapiens
  Genbank Accession No. AA598829
ctttgagccagtgttctgtttcttttctggtggaagagcctttttgctttcttccttatattgctccaagagtttttgggcttcttccttctgaagttcaacataggttatttcatcaaagcactcagctacctctgggagggtaaagtttcctttcattttgaggaccgcatgttctggtaggtctttcccctctacttctgctttcttctgtgttctttgcttatagtcttcatcttttgggcaaactacaacagcttttcgctggaagcctgcaaacaggcacatttttctcctctgggcagcagcagacacatttgtctgatccagaataaaatttcgcttctttcgggcagcaatctcaataaatttcccaagacactgggggggctctctgcaacagtggtgttcagttttccagtatctgccatttgcttcttaaaacctgcaatcatcatcttatccataatagtatttgtgcaagaatgttatatgtccctggattttctgc

SEQ ID NO: 1440 - DNA, 230 bp, Homo sapiens
  Genbank Accession No. AA598831
gcagttatttcaattcaggttttattaaagttgtttctgaatattttttctcagtgatccttgttctgatgaatattacatttcatccttagttttgctcatttgattttgctttagtgtttaaagaacttttatttatcagatcctttgccatgaatgagagcaccaaataacatatcaatacccaactgcctgattcctttacagcagtaagaaaagtcagtaaaaca

SEQ ID NO: 1441 - DNA, 174 bp, Homo sapiens
  Genbank Accession No. AA598926
ttttttttttttttttttttttttttcaccatttgggacgtctttattatggatccgtccactcttccaggagcagtagcccttctaagaaaggggtgggaagaaaaccagcctacccttcaagctgacttaggatgcaatggtacagacaccagccttgggggagggttctcc

SEQ ID NO: 1442 - DNA, 397 bp, Homo sapiens
  Genbank Accession No. AA598988
tttttttttggtttaaaaacaggagactatttaatccatctaaaaatacaaatcaggaaatggggggaacataggaaaatcctccacctctaacagagcgaagttactggctttctgcttgctccaagaatcccaaggcttgatgtttggaaggaattatctgttcttcaactactcccagatactcagacataagttacacacatctggagaagggttctgccctgctgaagctagatgggagctcaatgcatgggagaaaggagcatcaatctagaaaaaaatgatcaaagaacagctgagtgacagtgtggggccatcccaggcaagtgggctcttggtgctctggtgtagccagaacccatacaagctgggctggcctaggaagcccaccagc

SEQ ID NO: 1443 - DNA, 512 bp, Homo sapiens
  Genbank Accession No. AA599107
  unsure (1)..(512): n = a or c or g or t
tttattttcattctgagtttatttaacatttcatccagttgaactgaaataatacatggcctccaacactggcaagacgctgtgctaatactgaaataaaagctgccagtcagtaaacacttacaatcatcatcctttgtatcatgttaatagaaatattaataactacttagctttataagcttattgcacttcatgtggatttttttttctccagaaaaggtatttctaaaagatcggcaaggattgccaatcttgatttgttctttcttataaactgtgatcaacatacagttgatagctttatataaaagcattaagagtctgaagcatcanaaaacaacgtttaaaaagatgcagctccatgttcatcatcccctttataatctcttttttttttttttgagatggggttcgcccctgttgccaagctggagtgcaaggtgcgatttggctcacggaaacttcagctccggattcagcgatctcctactcagcttccgagtagctgg

SEQ ID NO: 1444 - DNA, 427 bp, Homo sapiens
  Genbank Accession No. AA599199
ggacggagctccctctgtcacccaggctggagtgcagtggcgcaatctcagctcactgcaacctctgcctcctgagctcaagagattctcttgcctcagcctcccgagtaactgggattacaggtgcccaccaccactcccggctaatttttgtaattttttttagtagagatggggtttcaccacgttggccaggctggtctcaaactcctgacctcaggtgatccgcccacctcaacctcccaaagtgctgggattacaggagtgagccaccgggcccagcctgttttctcttttctcctttccctggggaagagggttggccggacagaccctggtgtggctgggatgggggactgctgcagagaggtaacgggcccctgagatagacatgggacagcccgaaaaggtgggactgagaggggac

SEQ ID NO: 1445 - DNA, 419 bp, Homo sapiens
  Genbank Accession No. AA599211
ttcacaaaagccatctctctttatttttcattcctgccgttcaaccagtttgtgcaagctgaggatgagtgggttttggaacgggaggcagagcatctggggacagaccctcctggaaatggtctatgcacactgctgaggctggttagacttgagaagcaattgacaataaactctacagaactggaaatgttcaaaagtgtcaaggtggcttctggctgttttcctgcctccctgtgggggtcagttatacccatcagtcctgtgcaaaggtcctgggactggcccaggggcagccggattcttcgctggggacaggagctgtcctgctcacccagcagaagcatgccaatggacaggtgctcgggtgtgtgcccaggtgctgtggcccccaaactccgtggctcctcaagcatgtc

SEQ ID NO: 1446 - DNA, 394 bp, Homo sapiens
  Genbank Accession No. AA599214
ttttttttttttttttttttttttcattctgcttttctttattgtctggctaacttacaaagatgcagatgtctagggtagtctctaccctaccacttacactatcctgatgacacagatagcaaaatgtgtctgtttacatagtgcatggtatgaaaaaaaagtttttcttcctctacggtccttgactataaggagggaaaaattaatttcatgccaacatttttggggaactttaacaatcatcccatttctgctactaaaataacaaaactggtattacactttaaaatataaagacctaacagtttttacaaatatgcaaataatctactacttagacataaaaaaaagttgatttcttttaaatcacaaagtaaggcaccattggatt

SEQ ID NO: 1447 - DNA, 356 bp, Homo sapiens
  Genbank Accession No. AA599234
ttttctaaatgaatatcctttttattggattttttccaattacaaatgaaatttcattttacatctataattagaaacaacacttacaatgggactgtacaaatttaggtcaaaataaaaatatatgtatcttgtgacttcataaaacatcctttactatatttttaaagaaagcagaagtaacagcaatatatgtaaaagtaatgatttaatgactatgagcaagacaaagcaatagaattgtgcttcttttgcagactggggacaatgaaatgtttagctacaattttcccatacaaacatgaaacaatattcatatagaataaacaccctcacaaataactgatgggtgatga

SEQ ID NO: 1448 - DNA, 557 bp, Homo sapiens
  Genbank Accession No. AA599244
tttttggccaggttaattcatgtcaacaacaaaaaaatataatgaaagtttcacaattctagcatgcttgatggcttcctatttaaaataaaatggtaaatgatgtatttatactacattaattatcagtactgacctctgcctgtggtttacctatactgatatctttcataacagacatatctggatcatttgaatgtacttcaagttttttcagactgacggtaggtttcatttcctgaagttgctttaagacaagctcagtgcaatctttaagattcttgtctaaaacaatttttacattatcactgcactgaagctgtgatggattggcaaactgtacaaacgtttcgctttctttacaaggacatacatgatgtccactagtcacagcagtcttatcaatattttttcttgaatttgaatgggatcctttttgtttccagtattcggatggtctttgtcagtattgttcttctgcttcactgcagactcctcaagaaacttcagaaatgatacttcaaatccattggcctaaaagagctccagtcaaaaga

SEQ ID NO: 1449 - DNA, 271 bp, Homo sapiens
  Genbank Accession No. AA599365
tcacatgatagttttaatatttatttagcagaggggtaaattgaaacatcagttctctagaccagtcaggaaatgtatgctttgtgctttataagcttacattcaacatagatgacataagttaccatactcaaatgtaagatagggagaggtagaagaaatagctgagaacttgaaaagatgtactgttattgtcaacaaaccaatgtcttctcccttcataaaattgtgtttagggaatattaacaattaagcttgtatacaatagtaa

SEQ ID NO: 1450 - DNA, 393 bp, Homo sapiens
  Genbank Accession No. AA599469
aaattaaataaacttttattttggaatgatactagatttacagagaagttgcagagatagtacaaagagttcctgtatacccttcacccagcctaccccaaggtcaacatcttacatcaccatggtacatctgtcaaaaccaagggactgaaattggtatattaactaaaattcagacttttttcagatttccaattttcccactaatgtcctgtttttgttccaagacccaatccaggatgccacattgcactgaagacactctcccttttcaattctattactggtcacctcagtcaactttcccggggaaagagaatgcatgggaaaagctcttgtccttattattgaactggagaaactgaggcttaaaagtgccgagtgaccaagttc

SEQ ID NO: 1451 - DNA, 377 bp, Homo sapiens
  Genbank Accession No. AA599472
attatgtaggattagatgcccaccaaaattcttgtaaatgaagcaggacttgatttcaaattctgtctatacacacaatatttggccacatagaccactccccaaagtctgcaaaacactgcctactgggcaggcttacagtgacagaaaagtatgagaacacaagatattatttttataaagactaaaatcagatttaggctgtctagatatcttattccagaaaacacagatttaagatttttcagtgattcttgccttccacctccccttttcttccccaatgagataaccatttctttcacaatgatgaaccatccctttttatggaaaaatggctttctttctccattggatcaggacaaagacatcacttc

SEQ ID NO: 1452 - DNA, 317 bp, Homo sapiens
  Genbank Accession No. AA599522
ttttttttttttttttttttttttttttttttttttttttaaaaaataaggagggagctttatttaatatgaaggttgaggcagggccggggcgggagggcgctgtcacttggtgatggtgttcgcgttcatgctcttgccgctgccgctgagcacgatgtagggggtcttctgagccttctgcttctcctggagcagggccacggtgcccaggggcgtgtcgctggagctcatcttcttcaggagcgcctcctcgtccagcttcttcatccgccgctctgtcttcatcttgcctgagcccttgccatggaagcggt

SEQ ID NO: 1453 - DNA, 394 bp, Homo sapiens
  Genbank Accession No. AA599526
aagaccattgtgaggctggagaaatttagcctatgtcttccaccatctttcccggatgcggagaaaggagactaaaatctggaaaagcaaataagccaaaggaggttttcacaattatcatcttctaggaatgtttttcttatttaaaaaataatactgattttctgggaaaaacaaaaaaacaagccagagaagactgcccttcaaaccaaaatggtaagaaaggcagctatgaacatggggaagacaagtgtgaacatgaggaagacagggatgaaggtgtgaaaacagatgtgaggataagaagacaggtgtaaaggtgagaaagaggccgggcatggtggctcacgcctgtaatcccagcactgtgggaggccaaggcagatggatcatc

SEQ ID NO: 1454 - DNA, 469 bp, Homo sapiens
  Genbank Accession No. AA599585
aggctacttcaactaaattttaatgttagcataaagaaaaagttccttgatatctttatcaagtacacatcgaaacaacctaaaatcatttatcaggtactagaaaatgtttccaatgtatgatacagactagaaagcatgcagtcctcaatgtaaactaaacacaataaatttcagagaaaaacaattttaaaatggcttaaaaatatatctaatgaaatgtggggtcaaagaagaacattttgaacacataccgtagttgcaaaacaatgatgttacctcgtaagattataccaaagctttcatgagaagcagttttttatattactttaattttattttagagatggagtctcgctcttgcccagccagagtgcagttgcaggatctcagctcactgcaacctccgcctcccgaattcaagccattcttctgcctcaccctcctgaatagctgggattacaggcac

SEQ ID NO: 1455 - DNA, 408 bp, Homo sapiens
  Genbank Accession No. AA599808
tttttgtttttggtgtttttaattgtttttgttaatgtaaaaacagaaccatcacagccgctcagctctataacccatccagcccaagactgttctagtggtgaaaccaagagtagacaggtcttcctacctcagtgacctcaaaacacaaggacatctccatagggcatcaacatgcatctgtcatccaagaatctaagaacttcctgatccttccacattttctatcaataatattgccttctgaggttatggattccaggtcttctatgaaataggtaaagcttcctttcgcgttccaagaaatatagtttgcgaagggaactggaaaacgtgactctaggcctcagccacttcctctgttaccctgtgcaagttgtagaacaatccacgttctcacagctcccc

SEQ ID NO: 1456 - DNA, 460 bp, Homo sapiens
  Genbank Accession No. AA599814
ttttcaaatcctaaatatttagtcctttatttaagcctgcccctctaaatttaaaaaggtatcagcactcttggttaccaattgtaagcaatataaaaatttcactggtatcaattctaattggttcagtccatccattttcttatacagtgaatgtctttttttctatcagaatccaacagaagaataatgcaaatctcacttctgagcccacgggcaagcagtctcaacaataaccaaaaaatgtcactttacgactggtagtctgtttctgaagtaaaaatattctcgccagtaatcaaaatttgtcatgaggaaatccttcactgttcaagaagcacagttcgaagctcatcttctttattgatcatcatcgaagcaattgcaccatcattaaactcaaaagaagttcctccatccacaaccatacaggcatcccaacaacgagaacgaacacaaa

SEQ ID NO: 1457 - DNA, 359 bp, Homo sapiens
  Genbank Accession No. AA599850
aaaaggtgtttcagatatactgatatgtcaaacaaatagtaaaacaacatagagtaatgattcattttggtaaaaaatatatatgtatatatagaaaaaaaaattctgcaaggacatatgctaaattggtaacagtgcttacccctgggaagggggtatacagatgttgatttactctttgggtacctgtatttcccagtttttctataaatcacatcatttgcttctgtcataagaaaaaataatatctattatcatcctttattttgatcaaaacaaatcaattttttaaaaaatcttaggtttttttaagaagcagaaataatttccaaattgcctccagagacaatgattttatc

SEQ ID NO: 1458 - DNA, 363 bp, Homo sapiens
  Genbank Accession No. AA599937
tctgaaaatcagccttttaatctagttgtgtctcttctcctctgactctgggaatgagatttttctactcccacaggcttgaactctccttataggagtgtctccacatgccaaaatcagaggaagtcagaataaaacctcccaaggctgaaaactagagctggcacgtagtacatggtcagtaaatgtttttaggtggctggatgagtgaaggaatgagtgagtgagtgaatccaggatcgatctggaaacacaccagggctcagacctcttgggctaagtgccagtctcagtcctcttgggctgtgtaacaccaaagagaacaccccaggctctggcttaccccaagggcacacccatgct

SEQ ID NO: 1459 - DNA, 348 bp, Homo sapiens
  Genbank Accession No. AA599954
attttatagacacattatatttattcagaaagattaagtatttcaaaggtaaaaaatgaagctaacatttgaagattaggtaagtttcatgttacagaatataaagatgaaaatggataaaaaattattatgaagtacacacattagaatttgacttgcttagtttgcctctttgtgcctctacctttatcaaagataattatgtgactaagtatcataactaagctggtacatggaatggacaagtgaaaataggtgggacattagaattattatatatgagctcttctgacttcagagtaaaatttgtgttgctcattcctagcttccaaaagtgaataaatacat

SEQ ID NO: 1460 - DNA, 425 bp, Homo sapiens
  Genbank Accession No. AA600153
tgatttagatttatttttattgacaaggtttataagaacaaatatttaaaatcgaaggccaattattaggtctcatttagttgcttattttgttcacttgtatttacctttccctagtgtctgagtaactatcaagaaacaaacctgtgaaaatacctgttaacattcaacatatatttttatatatttctgttctatgatgcaaagatatttttcaacacttaattggtgcaacaaatgtgtcattgtgtcataaacagcatgttttaaaattcagatttaataaactgatttaagacagtaaatttgaaagacaaaattaagtctcattcaggagtggtccattatgttgatcatctagaatcaacactgattaaccaaactctgaaagccaagagccccaactccagagaaacattaaattt

SEQ ID NO: 1461 - DNA, 417 bp, Homo sapiens
  Genbank Accession No. AA600248
cgtgacgataaagctttttaatcacctaggtgcaggcaggctgagtccaaagagagtgtcagcgaagggagataggggtggggccgttttataggatttgggtaggtaaaggaaaattacaatcaaagggggttgttctatggcaggcaggggcgggggtcacaaggtgctcagtggggaagcttctgagccaggagaaggaagttcacaggttaatcgctcagttaaggtggggcaggaacaaatcacaatggtggaatgtcatcagttaaggcaggaaccggcccttttcacttcttttgtgattcttcacttgcttcaggccatctggatgtatacatgcaggtcacaggggatatgatggctttgcttgggctcagaggtctgacacacatcactaagcattgtttgatctgt

SEQ ID NO: 1462 - DNA, 379 bp, Homo sapiens
  Genbank Accession No. AA608545
ttttaacaggcagaaactctttaatcaggctttttttccaactctaaaacaaaatcccattttttccttaaatttagttcctcaggaacagagaactttgcaatgatgatctcaactctgcatcatctggtgactcctgattctgcaggactaagacatttcccaagagttctgctgcatcagccagtgaggacaagagttcttcagtgcggttcagctcaaggacacctaggcttccccagcaggggcttgcttgcaggtctgacaaaccacagagcgttgagcagatggcctgggactcccagacctggcagagggttttattagggcccgcctgggctgcaccgtttcatccaagtaccctgacccagcactcatc

SEQ ID NO: 1463 - DNA, 381 bp, Homo sapiens
  Genbank Accession No. AA608546
ttacagtgatttcaaacagtttaatgtaattccaagacaaagtgtgattacatttctacacatatacaatatgcatatgtgagtttacaaattttaattaataagtcatttcacctcggagaccgaaaaaatgatcaaaaagaaactatgagtaacaagctataacatagttcaccacaatgggaccccccccccctttttctcaccctacagttagtaatattacaattaaaataactatattcttctatattttttctgttaaaatcatctcataaatttacaatgctattattagtttccaagactaatataaattcactccatttttctacaacgaaaatgattaatttagaagcacacgacgtcatgatgaaaaac

SEQ ID NO: 1464 - DNA, 413 bp, Homo sapiens
  Genbank Accession No. AA608579
  unsure (1)..(413): n = a or c or g or t
aataaaacacatttgtttcatatttgctgaaaagtaaaacaataatattgtacgaaatgttatacacagggtaggttgtacatagcagtttcagaaacatcattgcatccaccagagaaactattctaaaactgatattcacacattttttataataataataatatgttagaaacatacagtgtggcatttagtatatacactcccttgctcgcaagcgaaaaatcctaatcgcttctgtataacatgctttattttaaagcctaacctttaaaaacactgttgtgatattactaacaactgcttttataaaattaatttgacatttcgatatatatacatcctttcagtcatttaaaatgttaacaatgctaaacttaaaaaataacaagcttatagntaatggttaaaat

SEQ ID NO: 1465 - DNA, 442 bp, Homo sapiens
  Genbank Accession No. AA608668
tttttttttttttttttcctgagtggagagagttgtgtttattcaccatgtcatacgcgcatatagggaacctctatttaggagctggtggcctgcactcagcaccgcacagataaaaatatacgactttcaacacagatccaaataccctcacattttaaaagtcaggattccctacacaagttttaagctgacgggattcaagttctgagttttcatacatagctttaacttgtattaaacacatgtttatttacaacgtggagagagaataaggggcagttaaggccactttctcctgtgaaacactgcaaaatatgtacataagtacaacctaatataggcaaaggttctaaaaatcatctttcttggcttcacgtaattgagtatcagtcggggagtggagagcggctgccgatagcaccaggccatgcaggccacg

SEQ ID NO: 1466 - DNA, 515 bp, Homo sapiens
  Genbank Accession No. AA608671
tttgcaagacagtaaaaagagtgaagagaatgaaatagaacagtttactcaagctatctttatgtccaggaagaaaaaagattacatgctgctcgcagtaagtacgagctttccctgcaactctggctgcaggcgcgcaagcggttcaccactggagttcctaccacagcaggggattgagaaatgtctccaaacactgaaaagctccatgtcaggactggatgtgtggttgataacctttgttcagtaaaacaaatcacagtaggttttgagaaggaaaaaaagaatgctcacaactgaatcggtagagtgaaggtttatcagacaaagggacatgaggcaaacaaattttaattacagaaaccaccactgcaatgtcatgtagaaaggagaaacaagggactagcttcctggatggaccaaaaatacagtttatagactgtttcaatcctaaaactaagacaatttctagatttacctcagacatgagtagacgtctggaaaatggatggaat

SEQ ID NO: 1467 - DNA, 463 bp, Homo sapiens
  Genbank Accession No. AA608723
atttcattactgggtaacaatctacttctcagcttagaatgctatagaaagcctccacatttaatttaatcaaatctgaaacccaataagcttaaacaaagtgaatgtttttcaaagtgcataatttccaactcatccacttgcaatatttatccaattccagttcatcagcaagaaaataaaatgtacttggctataaaaatactgaggaatgttatcgaaaaggaaaggctatttggtagaagtaactacaaaaataattagtttaaatctttgtaaagctttaatgtaagaacatcagtacactttctttacataaaccttaaagcatgatcaataccaagatttcaaattttcaactttcaagtacttgaaaaagggttgcaacaaagtgtctcttcccaaaaaagcaagaacagtgatcatgcaggtgttaatctgcagacatctgaggacactggta

SEQ ID NO: 1468 - DNA, 472 bp, Homo sapiens
  Genbank Accession No. AA608729
ttttgagacggagttttgctcttgtcgcccaggctggagtgcaatggcgccatcttggctcactgcaacctccgcctcctgggttcaagcgattctcctgcctcagcctcccgagtagctgggattacaggcatgcaccaccacgcccagctaatttttgtatttttagtagagatggggtttcaccacattggccaggctggtctcaaactcctgacctcaggtgatctgcacccccgcttggcctcccaaagtgtgtgagccactgtgcccagcccagagtttctatcttttgatgtatcttttgaaggagcagctggagagggcaggatcaaaattaaatcacatgaaagtgtactcccctccgcctgctccttataaggaaccccttatgactagaacccaagaccagtacccacagcctgaaagggaatttcagacaaccctaccatagaagtagtgaagaaacctt

SEQ ID NO: 1469 - DNA, 315 bp, Homo sapiens
  Genbank Accession No. AA608751
aattattgagacggagccttgcgctgtcaccgaggctggagtgcactggcactgtcttggctcactgcaacctccgcctcccgggttcaagcgattctcctgcctcagcctcccaagtagctgggattacaggcatgtgccaccatgcccagctaatttttgtatttttagtagaggtgaggtttcagcatgttggccaggctggtcttgaactcctgaccttgtcatcctcccaccttggcctcccaaagtgctgggattacaggcgtgacgaccacggccggctgttatgctcatcatggcacttaagagatg

SEQ ID NO: 1470 - DNA, 386 bp, Homo sapiens
  Genbank Accession No. AA608802
tttccaaaagtgttcttttatttctagtaacatatattgtataaatactctattttatatgcacttccacaaaagcgatataatttaaaagtttttttcattagaaataaatgtataaaaataaatatgttattataggcatttattactaactatagtccttcttggaaggaacacccaaaccaatacttataaagtacatgtaatttatagtaacatattttactatatacatatggaaaaaatcatattctcacagaagagctgaacagacattcaccaggatacgactgttggacaagctgctggagatggacctgctacccctcagcagcctccccaccacaagacaagtgatctcaatgtccccaaacctgtgggaccct

SEQ ID NO: 1471 - DNA, 586 bp, Homo sapiens
  Genbank Accession No. AA608807
ttttgctgctataaaaataactttttttcaaatggcagtttctgactaatcatgcaactaaatcagtgcaaacattaaaagcaatcattcgcttaaaaaagaagcaaaggatttcatttcaagtataaaaaatataaaaagagtcgtacgagtccagtttcgtctagtgtgggtcaaccctttaaattgcatagttcacgtggcacttggacatctagagggcgagcgagttcggcgctcggcaaagggcacattctggacacacgcagatcggcaagtgctatgtcatgtgcgttcaggcaggtctgcaagtgctatgcgggcgggcgggcaggcgggcaggtgagtgggcaggggcacgtccacggccagccctgatggctggggcccacatgggcaacttctgcaaatcagctgaaagccttccccatctctccaagaccaactaggctgctctcctccttggcctccgctgaggggacacccccatcctcagcagttcaagaatgctcctccccgcatttcctccatgcgtctcatcaccttgctaggggtcattccaccgtccacaaacagttctagagga

SEQ ID NO: 1472 - DNA, 462 bp, Homo sapiens
  Genbank Accession No. AA608837
tttcgattttaataatatattttatttaactcaatatatcaaaaatattagcattccaggatataatcagtagaaaaagtgatcaatgaaatagcttctgttcttttctcatatgaagtctttaaacctgggctgtattttacaattccagcacattgcaatttggatcaactgcatttcaagtgctcagtagcctcatatggctggtggcatggcactgcacagcacagctctagatcagctaccagcttccgggaaattcagaggacagaggaacatgttaaacagcaccacagggatgcaatcagcaaaatctagattgtgggaaactctagaggaaaatcaagccagcttttttttttttttcccagacagggtcttgctctgttgcccatgctggagtgccatgatgtctcaccacagcctcaaactcctgggctctagcgatcctcttgcctcagc

SEQ ID NO: 1473 - DNA, 153 bp, Homo sapiens
  Genbank Accession No. AA608897
ttttttttacagttgcctgtttattatttttcaaaacaaaacaaaaacaaaagacattcaaaattcccctgtggtggacaactgagttgatgtggctgatccaggctgtctcccaggttgtctcagggagcatcagttgtactagggggtggg

SEQ ID NO: 1474 - DNA, 336 bp, Homo sapiens
  Genbank Accession No. AA608965
tttaatttttaattttaattacaaaaaagatgagtctgagaatgcatgtacagaagttttaaatgaatcaacttgtcatcaacagctttagggatcagtggagtggtcttaacaatccttgagttcaggctggagctggcagggaagatggggagccgcagacagcgtcctgtgctctaggaacacgggtacctgcactcaagccttaggaggcacgggggtccactggagcctaagacagatgtcctgggctgcctgtcgctcgcagctagctattgtttcctcctgctttcctccggtcctcacctgagctctgatcgccaggggaaggagctg

SEQ ID NO: 1475 - DNA, 383 bp, Homo sapiens
  Genbank Accession No. AA609008
ttttgaatgtaaaacaagtaaactttatttgggagatggggtgaatccatcactggttactggaaccctgagtctgcattttctcctcaggaaggcggtctgaaatggagtgggctgtgtttggcaagggttgtagtggtttggaatctgcttggctcccgagctgggcctcaggcatgtctccccagagtaaatgcccgggatcattgaggaagcgttggctgcgctggcatgttaggcaggtctgtacggtccagcgctgtcccctgcagcgtctctggcgctgggtgcaggtgaggcccgggacgaggagggaagagcagcctcgacagagagtcctcttcaccgagggatctcgccgcaagacgagccgcttcgcaatg

SEQ ID NO: 1476 - DNA, 315 bp, Homo sapiens
  Genbank Accession No. AA609011
tttaacatcaaatttggtttatttcaagtttgtaacaaaatatattctaggcaacttttcagacattgttttatagcatcataaaccccataccactgctgtcattccaaaagctgccaggacactggaagttatcaagtggtccagcccaggaatacaggtagaattcacatgataggtgataagaaagcaatgtctgtgggccactctgatccctctttttaccttggtaggtaaggtatgatcttaagactatatgtactgagtcctattagtcagtgaaaaagatttaagtgacaagttatgtgctttgtt

SEQ ID NO: 1477 - DNA, 329 bp, Homo sapiens
  Genbank Accession No. AA609013
tttgaaggggtgttgcttttattgcgggcctactgtgtgtgtgtcctgaactgtccccaggcatcctgccccccaggtaagcccaggcgtcctctcaggagatgctggtccttgcatgtgggcagcagggctcctggcatctggagtcctgggatgggcgggtcttcccggagctccggagaccctaaaggggactctggtctcccaggtttcacaggagagacagacagaggaccaggggagcgagggaggccagcaggagcccccagtggcgatggaggctggaagcccagaggagtagccgtaatgggtcctgcaggagccaccca

SEQ ID NO: 1478 - DNA, 429 bp, Homo sapiens
  Genbank Accession No. AA609080
tttgtagttcaatacttttttctttttaattcatactgtacttccatggctctagctactttacattaagatttggctgggcagccttgtgtgtttctaggtactagcagtaagttttctgaccttgcgcacagcgcaggcaaagtacagttatagatccaaatacagatggccagacaactcgactgcactcgacccgtgttctttcccatagatggcccagtgcaggtgttggggctgctccctctgcctcaccccactccaccccacgtcaggattatccaggggccactatggcatctgacccatccctccccaccttggagtctaggttgagttggggaaaaagcaccatgggtttgggaagatggtctggtccatgcagagagtggtctggcccttgagtgcagggtaggaaaatgtggggag

SEQ ID NO: 1479 - DNA, 418 bp, Homo sapiens
  Genbank Accession No. AA609132
tttaaaaatcgaatacctttatttgtgctcccttaagcagcatgtgagaagtggcagtgacctcagcagcaggcctggtatctttgccctgttgagaagccaagatctcagctgtactagtcaggtgttttttcagacagcaagtagaagaggtggtggccaactccagtgctgtatcctggaggaggtccgggtcagcactgggcaaggtaggtagctagctgcctgacccctagtctggggttggaacttctgtttgcctgagtaaagggatgtcagtcctaagatttctccacattgtgtctttcttctgcagtggtaaaaaggctggtccttgaattgtcctgcatggtaccctaaggcaggcccactggctctttttgatcaaggattctgagaaaagctgcccttggaggcc

SEQ ID NO: 1480 - DNA, 483 bp, Homo sapiens
  Genbank Accession No. AA609164
tttagaagtgaaagttgtttttattgtttatatattatcaagcaggcatctgatgacctgtggaattagaaataccagcagacatttccaaggggtaggtgcacaggtcaacagaactaaactacagtgatcttcccttagatccttttctactgaggtgaatagctcaaaagacaaggatgcctttagtccaggctaacccctgtagcctctacgcaattaacacagaagaaaggccttcctcccttccagcactggggctcaacagtggactgagtgtttggtagtgtacatttccaatcttaatagagcaaagccagacttctgctttgatgactgagctacagggacaggagtggtccaaggttctcaaattctgtttttgtttttttccagacttctatactattgtctgccctaggctgtagggaatgctggttagtttgctgaacagacactgtgttcagcagggtttgtggtatc

SEQ ID NO: 1481 - DNA, 408 bp, Homo sapiens
  Genbank Accession No. AA609316
ttttacaaattatatacatttatttttaataattttaaataacactcttgtataaattctttcatatattcaaatcatacacaaatttagaaatgcatgatgaagcctagtacagcatatgtatgagacacattttttaagtttgtgttagaattttagtgacataaatacaagtttaatgtttcagaaacattccctaattgctcggcctataatttaatgtattatagagtgcttatgcctagcattacaacttgactttaaatcatttagcttttggactaacttagatctgaagccctgggcttactttctagggctgctgctgcagcaacaagtaacaattcctacccacatagcccaaaatataggaaccagggatgttcattataagtggtgttatgttca

SEQ ID NO: 1482 - DNA, 464 bp, Homo sapiens
  Genbank Accession No. AA609519
tttattggactgtaggtttttattaaaacaaacatttctcatagctctaagcaaagcattagaattcatcaagcggactcacatcttttctctgcacagagagggctgaaaagggagagaaagtcccttatgtatgtctagatttggtaaagcgaaggatttcagcgaatgagtcactgaggctatacacgtttgcaaattgtaaggcactggcgggcagagagcacagataaaggacttctggggtcccccatcctgtccagcaacctcccagctcacaccttagcttctaccaagaagggtgaacacagcatccctgctatcttcactcagaccccagaagacacaggaaaccgcacagctccactcccaccataacttattaggagataagtcacattttatcaacttgccatcgcgcctcctatagattatacttcggtaaacccaatctgtataaattc

SEQ ID NO: 1483 - DNA, 513 bp, Homo sapiens
  Genbank Accession No. AA609537
ttttttacattttattagaatctttttatttttttctgcagaaaacatttgagatgctcatttgatataaacatctaattccaagagagaccagtgctcaaatatagttttttcagctaccatttgatacggccataaatttggatggtccatgttacaatccttccacaattctccacttaaagacatcatttttctatgtttttaatgactattgccatctaacaattctacaattcgcctctttgcctgtaaaaaggccaactctacgtccacctgtgtctcatattgctatcttttatttatctctgcttaagattgcaaaagtttttgattttattattcacctgaacaatgtattgcaattccaatacacccccatctcttgctgttatctacagcttgtgacaaaatgaacaccttgtagaaatatcctactggttgggtttcccaagtctatgacaccaagagagaagcattgctgatggattgacgaggagaccaccagatcat

SEQ ID NO: 1484 - DNA, 372 bp, Homo sapiens
  Genbank Accession No. AA609572
ttttgaaacatcagggactttaatcacatcccgcagctctgcgaccctgcccaggcgctgatgctgcgcacagcccacccccattccctccctcccgccctcctggccctggcagctcagctctgtccggggtcggagagggggtcctgaggcagcagcagcccagctccagagtgacaggcaggggctgtccagctgagtctccgcccccacgttgccctggggaggcccagctgctgtcagtgctgcttgagacactcagcagcatcttccaaggtcaggttggccaagtgtgggggctccagacaccttaaggctggcgataccaggaaggccggggtggctctgtgtgtcccaggccaggagaaggca

SEQ ID NO: 1485 - DNA, 326 bp, Homo sapiens
  Genbank Accession No. AA609574
ttttcgtggtttcgtctatttattaaaaaatatttgagaacaaaacctctgcctctttgagtcttgctctggcatccccagcatctctgattctccctggtgcccccagctcaggaagaaggtggtagtggggagagagggtcaggggggcttggcagggatgcaggcaccatgacttttgtgaccagttcctagagacgcatgggtgtagcctcaggaggaaagcgagaggagctttaccatgggaacgaaggaaagggacaacattgggaggcaaacgttgggagactagtccagaaacttgcagttgaggatacaacagggtc

SEQ ID NO: 1486 - DNA, 325 bp, Homo sapiens
  Genbank Accession No. AA609576
tttaaaggggaaaaatctttaattgatttctcaggtaatttttttccagattgtacataaagtgttcttatgttctctatttggatgtttcaggagacatacaaatgaaatacagtacatagacaaatgaaatgctaataagaagtaggatgatattaaaatatccttactttgcctgtatggaacaaaggcagtctactccatcggggaatcaaagcaaatgtgaataagaggtttccaccttgcaaaactgtgagcttcatttgccctggagagaactactaggcaaggcttcacatgacagtacctgtagggatgtccatgg

SEQ ID NO: 1487 - DNA, 306 bp, Homo sapiens
  Genbank Accession No. AA609614
tttttcggattttttttttttttttgcaaaacattcttttattaaaagaacaagtgctgtttacgaactgcccttcgtacaaataacatccgttatacaaagatacaagatccgggttatgcacaattccaggcttggaggtggcaggggggcatcgctttgggctgaggatatcaaggttttagaaagaatgaaaaaggagcccctgggtttgcaatctgtggcttcccctccctgctccctaggaagggtctgctacatggaaacaggttgggatagaaagggggcgggacgggagcaggggtg

SEQ ID NO: 1488 - DNA, 346 bp, Homo sapiens
  Genbank Accession No. AA609715
ttttgtttataattttttaattaaaaatttttaattgacacacgataattatacatatttatggggtacatagtgacattgcaatacacaaaatatacagtgatcagattagggtaattagtatatccatcatcttaagcatttatcatttctttctgttgagaacattcaatatcctccttctagctatttagaatatatattattgttaactgtagtcatcctacagagctatagaacactacaacttaatcttcctatctagctgtaattttgtatcttttaacaaatttcttcctatcccccattaccttttaaattaaatttattttaataattaggtaac

SEQ ID NO: 1489 - DNA, 380 bp, Homo sapiens
  Genbank Accession No. AA609773
tttttttttttttttcttttttttttaatcaaaaatgttttaatgattactgtttagacatttaacaatgtaggtatatccaggtgagctaagcacactttgacagcacactattgaatgttatagtttctgtattgaaatatgtaaagacatctgcaaattagtacctagcaatgaagacatacatttataaatatacacattctaggtttgataaggtaaatgtaaacagatgccatgactccttttcaaacagaaaacccacaagactaatagagaaccaataggctccctatagtacgaatgtgcaaaattaaagcatggtaaactgatatttacataaatatcaaaccaacaattagtttatacattgtcaatga

SEQ ID NO: 1490 - DNA, 414 bp, Homo sapiens
  Genbank Accession No. AA609774
tttttttttttttaacacataacagtttatttcttacacttaaaaagtttactgcaagtccatcagcactccagtcaggtcccttctaaacagcgacctaaggacccaggttgcatccgtcttgtaagtatgccatttggaacatcttgctttcaggtcaccatgacaggcaaaagaaaactggagggtcatgcagaactttttacagtccaacatggaaatagaaaatcacttctgtttacaatccctctgcttgaagtagtcaaatggcattgcctaactacaagaggtttggaagtgaacaggagcagatagatacatgatgagctgtaaatgcttttgccatattctacaaataatataagcttatagaaagcattttaatgaacaattctgaaaaactctatatggata

SEQ ID NO: 1491 - DNA, 409 bp, Homo sapiens
  Genbank Accession No. AA609786
tttagaggttttaaaatgtgtattaaatttcatgggtatgcacagtagagaaggcatcctcacagaggcaagagttccaacctggtgacaatggcagtgagccacccgtctagttttcaaccatctaagatagcagcagctggctgttgcccctggactgagatttcttcctctttgctggtggggggcggctggaacggatgggagacacagtgggaggctgaggccccttggggtaatcattctgtttctggaaggcagctttctcaaaaggctgctctggcaactgctgcttctcaacccccttggcccttccaaggggctgatgatggtccttaggtttcagggtggcctgagtcttggatggggataacacagccggtgtttgtgtgtctgtgccttgggaggg

SEQ ID NO: 1492 - DNA, 426 bp, Homo sapiens
  Genbank Accession No. AA609795
ccatttatttaaaacttttattaacgcttgaagaaaaataatgcaatgtgacaatgtacaggtcctgttgcctaaatccgtagtagaaacagatattatcacttagcaagctcacgtggtgccaattctgagatcagacggggttgttcctccttaggaagtggccactggaagcattgtttttccatgctatttccgtgaagccttttgcttggttcgagtttaaatttctccctttgtgtgagtatgactatagttctggcctggtgttttctatttatttagttttagatgtcagcattttactatacttggtcctctcacttcagaataacagggctatttattgatacaaaggagaggtgttcagatcatcttgttaagatgcagagctcaaaataaacactaaatctttatttggagatc

SEQ ID NO: 1493 - DNA, 448 bp, Homo sapiens
  Genbank Accession No. AA609934
tataaactagctgatgatatttatttggttcttaagaaactttcttaagaaagtattgggatacaataaattaaaatactttttcaacatctcagatttctccagtaacgcatatatgctggcagaccttagtgaatcacgttaatttatttgtaaatcatcaaaggaaagcataaaatatatgtctccaggcaagtgaatggactgggaagccaaattgggcaacagcagtattttcctgcgccagaagtaaacatgtcaacatggtgacgagggttttgtcccactcctggctgaactttgaagggtgagatggctaatatcgagggacccggctttgtagttctttctcacaaagcattccatgagtcaagagaaggacaatctgcagcatgacacagagaactaggtcagaataatatttcttaatggagattccaatgatgta

SEQ ID NO: 1494 - DNA, 330 bp, Homo sapiens
  Genbank Accession No. AA609942
ttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcacgcttcttttccttctttgcttcttttagattttttgtgtttgtgtctcctgtgactatctccttcttcactttcatggcgacgtctactattacttcgagaaga

SEQ ID NO: 1495 - DNA, 442 bp, Homo sapiens
  Genbank Accession No. AA609996
ttttttctgaccgatgacttttatcataaacagcagcttctaccacccctttaatactgcatcattctttgggtgtccctaaatgttttcagtattcctataaaatacaatgcggggcagaaacaacatcaaagccactggtgtgattttaaaccagggagattaactgttttgaggtttggctgaaccacccaaaataatttagtagtttccgctaaaaatgtaaacttacaaataagagggagactgctttgaatgataataccaatgcgtctgctcacagtacagcttgaaggccccctcctgtacccccacaaaaaaactcaaaaataggactgagatgccacagccaagcgggctgttcactccaaagcctcggcgtgggggaggcttccagctgccaggctggcctgcactgaagggtcagacgccagactgtggc

SEQ ID NO: 1496 - DNA, 449 bp, Homo sapiens
  Genbank Accession No. AA610053
tttatctctcataccagctcaattttaattttaaagtgacaaatgtacaggtggaataaaattttaagcgacaccctccaaattccttttatatgacaagaaggagctgaatgtaattttacaccattaccaactaaacagtagttctttagcaataattaggaagtcacagcacaaaaacgacaccccagagttgtggtccatttataaatagattttcacctaggcttcgttggaagaagtgattttatatctatcctcaccaatggtcaaagtgggcacaggtgggctgtttctatactttgagcaaattatgcctcactagctggcaatgttttgcgggaacctggtccgtgcagctggttcaccttacctgcatggtctgatctgcactttgaccctcctaaggaagatccctggtctgagtgaaactctcaggtgccatgtaa

SEQ ID NO: 1497 - DNA, 303 bp, Homo sapiens
  Genbank Accession No. AA610073
ttttcattttgaaaaagctatttactttttttccaaatattatcccaaaaggtgttttacagataagggtcaatacgaagtcaaacattctacagaagaaaatcgtttttacagacattaagaataattttaacagaagaaaaagctcacatctatctagatgtggctatgttccatgggaaaaatttcagcatccaaagtgcaaagaaaaaatgactgtagcttttcttaccacaaaatattgacaatcttcccttatagcctactctttattgttagttgggatgccaaaggatgatatat

SEQ ID NO: 1498 - DNA, 311 bp, Homo sapiens
  Genbank Accession No. AA610089
tttttacgaatgtgtgaaaaatatcacaccaagtttaaaaataactctttaatcatatgcacataaggggaataaagggcaacaccaggctgactcaggaggggagcaagatattctccctttgtcccagtgtctgcttggcacagttctgagatcacacaaacaagtgggagggggttgggaaatagaataagtgagaggactgaagagacaaaggcaagggaggagaggcaagggcttgcagtagtctcaatcagtggactctaacacagattcactcagcgcaaggtcccagtagtgttcagccccat

SEQ ID NO: 1499 - DNA, 337 bp, Homo sapiens
  Genbank Accession No. AA610116
ttttttatctatcaattcttccattactttcttttaattcaaacatgcatactacaaagaaaggtttctgtcctttaattttttaacagaatatacagagccacacaatacgatttcaatttcaaattatgggagatcatattcaaatatgcttaggtttgacaagttgctgttacaatactgagaactttcatgaaaacggtatttaacaatttttaagataatcaaatatctttttgctacgtgggccaacgcattaatactaacttgtttaaaaatgcagtcttttagacttcaaattattataaaacaatatcaagatcatatagatatactt

SEQ ID NO: 1500 - DNA, 166 bp, Homo sapiens
  Genbank Accession No. AA620343
ttttggtagctattgaatcagggccacacatttaattgatattatgatcaagatgttcaaggcaaaaaatactattacttatttaatgtggaacaagtctagtctttctcttgagctcccacctgctggttaggaggcaacaatgttatttggatcctgtttagag

SEQ ID NO: 1501 - DNA, 303 bp, Homo sapiens
  Genbank Accession No. AA620461
aatgttgcataacaatgtttatttagttttacatttgtttacaatttcttataaacacttcattataattgttttatacaaacaacagtttaaatttacttatgtttatcatttatttgcttactagtttttcaatttcagataatccttttagaatcatttcccttcttgaagatcatccttttgtagtctctttactgaagttgtgctgaggataacatctgtttttcatctgagcatctgtttgtttcagtttcgcttgttgcaaattctaagctaatagtttttctcagaattctaccc

SEQ ID NO: 1502 - DNA, 457 bp, Homo sapiens
  Genbank Accession No. AA620466
tagtttttctaagatcccttctttatccacatcacttcagccaacaatctgattggtatttccaagacaacagagcagtatttcaaactcatgaatgggattttaatgtgctgtatggaatttgaagcctcaaacttaaggaactttccacctggaaagcattcttaagtaacatcaatgaactgtcctccctaaaacctagacacagtatcactgtggaaacagagtaatagttctggaatcgattgaggattaggttagaagcgcccacaccaggaaaagcttccgggaaacggttttaggacagaatcaaggcacacctgtggaacctctttctgcatctgtcaaatggggacgctgtgtctcctctcttcttaggagaggattaaatgagccagagtgggctagcacagtgcctggcatgagactacagtttcactgggtgctatactcacta

SEQ ID NO: 1503 - DNA, 292 bp, Homo sapiens
  Genbank Accession No. AA620497
tttttttttttttttttttttttttttttttttcaaggagaaacagcgtttattgtggaggggagctgggcggggctcacctccggagaactggcagtacagccgccccagcctcggctccacccatagccggaacggattctccaggatggcagagaagccttcagccagcgttggggcctcgaactgcttcctgtagccatacatgaccatgtctgacacggggatatgagaggagtccgtcatctctcgaaaccggttgttgtggcgcgctgctccagagtggcggtga

SEQ ID NO: 1504 - DNA, 365 bp, Homo sapiens
  Genbank Accession No. AA620553
ttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgtgtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccact

SEQ ID NO: 1505 - DNA, 408 bp, Homo sapiens
  Genbank Accession No. AA620556
tgttttacaaaactttttattcatcagagctgtagtgaaatatcatcattgtaattgatattctagcactacaaaaggcacaatgaagcttatttagttccagtactggaaatcagaggtaacagcacatccttccttggacatgctttactctgctgtagtggtcatcacagttttgattttctggataagaagttcaccacagcatttgtgcattcatctgatagccatcttccctgaaggacattgcattcttcagcattaacagcgtgtagtttttctctctctcttttcctgattacctcttttgaaattctcaaggcatttgggggaagctttgcaaatgccttcagcctggtccagacttctttctgaaaagtgctatcagggaaaacttcagtaacaagt

SEQ ID NO: 1506 - DNA, 417 bp, Homo sapiens
  Genbank Accession No. AA620667
tttaggcaccccaattttattgaatgcaacagttgtttctatgaccgttggaatctttgaaacgcagccgcattttaggacgatacttctccaaatacagaagttgcttgctgttaaaagctccacgccgcttttgtcttatgaattgtactgcatcttcgtatttcattccaccttcaattaatgctagggcaacaagtactggagctctcccaaggcctgcaacgcaatgaacagcaatacaacaaccaggttcttcacgaaacttaattttcacaagacttaaccagtcatcaacaatctggttggatggtggtgcccatcatcaaaaggccaatcaagaacatggataccttctttctccacaagagtagtgtcataagttgcttcacatactcttactattgtggtaactcc

SEQ ID NO: 1507 - DNA, 423 bp, Homo sapiens
  Genbank Accession No. AA620761
ttttcctctaaaatacttagctttattaaagacatggtactaaaaataacagattccaacatttgctctatttctacttatatatcataaataagacagctgttgatgcaagacacactctttcacaatctttccatatgcacccaagcattcttgtatcagaataagctgtttaccagccaaccgtatgtggctgaatgattaaaatgaccatctatactttacatagtaaagcatcttccaaaattttaatgtacacagtgacaaaaaggaaaaacaaacaaaaaaaacagtaattctgaacacatgaagagtgattaagcagcttcataatcaaatcaggcttcattacttgcaacaagggcaactctttccattccccactaaatactaaagtttcaatcttattaacattaaaagaaa

SEQ ID NO: 1508 - DNA, 439 bp, Homo sapiens
  Genbank Accession No. AA620779
tttggtctaatattttttctttattattctgaaactgggtttatctaatacattgataaattcatacaattcggaagagtcagttgaagtcacaaggacccaatatctgccctctttcagtgaatgccggcaaatctgttattccattggcaaaatcgtattgctgctctcctgttaatctcctatttataaaaggatcatgaggctgccaagtgctaaaaatggagatggtctagtaactagaaaactccccaccccagggagcacacatacatatctccctacaacctaataatgtgatgtgttttggaacacagacattagaacttcatgaagttttaactgttgattctttcccaagcatcatcaagttatgatttaggcaatgtatgattgaaatgcattcactcatcacgcataggcacaatcacagaaatat

SEQ ID NO: 1509 - DNA, 227 bp, Homo sapiens
  Genbank Accession No. AA620830
tttgagaccttgatgagtctttattttaggaagcatattattagcttttgattttaagaggaatttactccttgctttccctgttttggggaaaatgaggagagctgcctccaaatcagggaattatattgacacaggtagacatagggaatggaactgaatgaacccaaggtgttacattttgtttcactacacatgagggagaagaataagccctgctatagtgt

SEQ ID NO: 1510 - DNA, 375 bp, Homo sapiens
  Genbank Accession No. AA620881
actactcataacagtttatttttactttgtacaaaatacaaaaatgcaaatccaaggagtacagaccagtagtgacaggcacactgcacaacagcaaccttgtctagcaagacaggagttttttaaattttattttagtgaatacatgcattatataatacaacaacaacaacaacaacaaaaacacaaagaggctagagatttcaccgtttctacccccaaaataacgcttgctatcaagactttggagggggatgggggaaaagaatttaaaaggcaaataatttttttctcataaaaagtaaaagctaccataaaacatttttttttctgtcacactgattaaatttcttctgaaaagccgcacatatagac

SEQ ID NO: 1511 - DNA, 517 bp, Homo sapiens
  Genbank Accession No. AA620965
tttttcagtggccattggagatgtttattacactgcttcggctggacacgcaaccatgtgacactaatgtgtcatagaaggtctctgagcactttggctcattttgaatataatttttaaaaatatacacaaggctggctttccaatgtttaaaatcattgtagaaaccaacaggttgaacagaaatataaaagtacagaaaatggttttcctgctttggtgttggttgtggcggccgaggaacgtgactgctgctgtttacacaagtccagacgctgccagggcctgttgggatcagctcagtctgcgactaaaacagctggatcatcgactctcttgacttgccaacaccaacccatttgactgcgactcccacgtgattctccacaaagcggatgtagttctgggcctgtgggggcaggtcctcccacctcctggcgcctgtggtgtctgctttccacccaggcagcgtttcatactcaacttcgaccttctgaagcatctcctggttagctgg

SEQ ID NO: 1512 - DNA, 470 bp, Homo sapiens
  Genbank Accession No. AA620995
tttttttttttttttgagaaatcttgcacaaatggcattttattaaagaaaatctaatttacaaagctttgtaaattttaagaaaaacattcatagatcataaacaaaaatttcaatatgcaatattcaaatttacaagaaaataagcacaaacttttagacagtgcagttattgctgcactcctttaattccttatccagagcccaaaaaatgtagacaaaccctaaaaatgtagcagaagcatttccgcacactggtgtccagaatctagtttgtgcagaaatgtttccactagatttatagagtactcttcagaagaaagaggcgagggctcgtcatttggtcaccctttggacattttgcaactcttcaatgggtttccattgttggttgattgttataagcttttgaggtacagtagggtccacagtttcccaaggttctggatttttttttcgatcaaggatca

SEQ ID NO: 1513 - DNA, 380 bp, Homo sapiens
  Genbank Accession No. AA621131
gaggattctcactttcatttattttcaaggcatatacaaaagtctgacatggtgcaatgatctcatcaagagataacagaacacacaggagagggttgggtttcctccccggcccaaccccctcaggaaggcacagaaaagtgaggcttgggttcgggggccacctgctttggaactaatctgctgctcagaaggccaggccccttctgaagagggatctcttcctcacatccagaatctaggatctggggaaggttaactgaggccaccagtaagcatgtgctccaggccaaggctgagtctgtgctgcatccatgtcatcagccacccaagaaaaaccagttactccacctagctcatggtggcggcatcctccctgc

SEQ ID NO: 1514 - DNA, 464 bp, Homo sapiens
  Genbank Accession No. AA621146
tttttttcagagaatggcactttatttttaagacttgatttttttgccatgattatctaccaattcttccatgatggtgtcatcctcttcaacagtgaccaggaccttcttgcccactagattaaagatgtcttcaggaggatagcctttgggtcacccaccttcacggtgagcatgtccattgttagaatggtgccttccggaattttcactttggccaccacagacttgcccagcttctcattgcaggccatctcacagggcagcagctgcttggttggggagcccagggcacgctccacaagacgcaatgaccgcaccagctcggccagttctccaggctccagcgaggccgagtggtcactccacttccaggtcttgtccaaagttatgtgacgttccaacaacttggccccaagagccactgcggccacagatatcgctatgcctgtttcatgcccaga

SEQ ID NO: 1515 - DNA, 211 bp, Homo sapiens
  Genbank Accession No. AA621192
ttttttttttttttcaggagactttacagtttaataaaccattcaacctggagaaagggaggtcgggacttaggtggcggtggactaaggacatgacaggagccataggttgtcagggagctggagcccaaggtacaggatgggaaggctttgctatggatcccagcctttctagggctgggtagtgggaacctcccaaaattggagttcg

SEQ ID NO: 1516 - DNA, 345 bp, Homo sapiens
  Genbank Accession No. AA621209
tttttttgatagtaaaataattttatttagtttcttattttaaaaaaggtagcatttcaacatataaatttagactcaagattacagtgtatatttgccaaaaggaacaccccgaaagacggccagcctcagagctgagagggcacagggaggcacactcctcacacatgggagtttaagcagaagtgctttaagacttcacagcggcatttccctgttcctcagccccgcctccagggccatcactttggggcaacagcttttgctcatgtaactataaaacatctctaggaatgaaagcacagaggtcaatgatccagattttccacaacaatcatctgcagc

SEQ ID NO: 1517 - DNA, 444 bp, Homo sapiens
  Genbank Accession No. AA621235
tttacctagaggttataggaagggatgaacagagatgacagacaagacaaaaaaggttatgagagaattcctcattatacatgggtagaattcaccccagaaaccaaagaacttttcataattacaagggagggacagcacagggcacaagatctttgaggtgttagaagacaggctgacagaccaagcttggtgactggcttaataagtctcctaccacttgaaattctgtgttatttatttaaagagaggcagaggaagagttcagaagccagaagatttttggaagagaagttgagcctcttgcattttcttacatcattaatttccttcaccagaagatatagttggaccaaattgcaatagggttcgccaatggactccattatgtagtcgacctgtgctcctcactaggccctgatttcgctatctgataacaaaggc

SEQ ID NO: 1518 - DNA, 446 bp, Homo sapiens
  Genbank Accession No. AA621242
ttttttaacttaagcaaaaaagggtatttattggttcacataactgaaaagtccaggggatattctagcttcaggcacggttggatccaggggcacaaacgctgtcatcaggattcaagtctctccatattttggctctgctttcccctgcactggcttcattctctacatggtaggccctgttagtttgaggttttcatcctacaaagctaaagcaccctcagtaaagagagcttctcctccacagttcagatggatttgctgattgatgaggtctgaattacatgttcacccacaaagctcaaggttgggtcagactgtccaaaccacagactgaaaataggaagaggtggttttaagaaacatcagggagttgttacaagatggaacggatgctgggcaattaaaaactactgatgtccaggataagaacagatatgaaaaag

SEQ ID NO: 1519 - DNA, 435 bp, Homo sapiens
  Genbank Accession No. AA621274
tttaacccttttattcaatacaacattttgtttgcaatgtaaaagatcttatatttggtccaagcctaagtcatgccactttgaatctctcaaggccttaagtagaaagatatttcctgaaaagcacatataagactgctagtgaatcttctccagcaccaaaaagtctgccactgtcaaagcagaatgcattttaaaggcacaaagtcagcagtctgaccattttccagcgtcacgaaagaagcattacagtatagaagaatcaattgtgcatttaagaaacaaaacacatttagagttatcttaaaaagttcaaattgcatttgttgatccatatcattattagaaagaagaaaaaaacggagtgttatatttaacttcccctgataaagctgtttcctttcaaaaatttcttttttaaatttacttttggtc

SEQ ID NO: 1520 - DNA, 311 bp, Homo sapiens
  Genbank Accession No. AA621277
tttctccagggagttttatttcctcagcagctgtttctcccatgcctgggcttgtgctaatgtggggcctgggcggacgtggggtcgggtgggcatctccctcagactgggcaacctcaggtgccccagccgagttcctgcagcccgctttggccccaggcagtcctggagagggtctggctgttttctttgcctgctggtgacgtgatagcagcccctgcctcatggcctgcatgtgggccggctgggctgtgctgaggcaggttctagaacagtgatctgatagcatccaaggcagaccatgtgggtga

SEQ ID NO: 1521 - DNA, 439 bp, Homo sapiens
  Genbank Accession No. AA621315
ttttttttatagaatctagcaattaccaagacatttattagttgtcaaaaagctttacaatcagtttcatgatcagaaaatagagcaaaatttcaatattgttttctttataaaattgatgaatttctgaaaagataaaggatcatttgatttttaaaaatgtcagcttcatcacatgatgttccagagatctgaccccaaaagcttctcaagttttactatccatagtgtccttatttgtaactgagacccatccgttattttccatctgaagcttcttcagcagtttataacaaagtgaaagaagttggactaagagagccatcatggatcttgtcttcgtaatacacttgtcaacctttagaaatactttattctgcaaagaagtcttagttactgtctggagctggtggcatagaggaattagcttgtttatttc

SEQ ID NO: 1522 - DNA, 431 bp, Homo sapiens
  Genbank Accession No. AA621325
tttttcaggtttggcacataaattttatttaactttcacattgacacaatcaggaaaccattctgagaaaaggtagaggccgccttgaagcgaacgctggctccctcctccaccccgggctcggcggcaccatgcaggctcaggctggcactcatcccaggaaactgtcccagttctcagcggtcctggctgtggacggtatctgaaatggtcgctgcggcttgccctgcaccagggcctaccttgttgccaggaagccgcactgctggaggctacctgggcgctgggttttattgctggtgaacttggttacccaccttccagtcacatggtccaggatggtggtgtgatcagaaatggctctggcagtgccattttgctgagatgaaaggaatcgaaatgtataaactacactgaattctgtgatgctg

SEQ ID NO: 1523 - DNA, 464 bp, Homo sapiens
  Genbank Accession No. AA621367
tttctagttcttgactttaatgcccttggagtgtactgaggctcaatacaccaaagcactcacagacaggtacatgaactcacacaggaagtgttatagtgtgtacataaacccaacaccatacagaaggaagacgacggacccaggtgacaaaacttctcgggacttcctggtcaagccctagctatcagcctcaaggaaagactaccatgccttgaggaaaggccaggtgagcgctggctggagtgcctgcaggccgcaagccctgagcccaaccctgaggtgcagtcagggagattggagctacacctctgtcccctgggagctgtgcctcaggatgctgttctcacctcggcagattctggggcagtcagcagccccttcagggatcttactcccagagccaccaagcaaggtggacatcctccctgatgggactctcgcctaccggggctactcaccac

SEQ ID NO: 1524 - DNA, 410 bp, Homo sapiens
  Genbank Accession No. AA621409
ttttttcaaaaagataattaacttttattattcattaaaaatgagctttctaaaatattagtaaatttcattttaagctctgtcttgaagtgctgataccactgaagtaacatttttcttctttcaattttttcttgtaaaattatagttttctctttttctaaaacagcagggagttccttccagttcttgataaagataaagggagcacccatggacttgagtaactgcagaggagcaccgtggctgacagatgtattcccacagttgccagctgtcatcacgtcttccaccacaggaatggagccataggagcaagcctcatagattcgatagcattctgtgtttactccgaccgggcacaatgtgagatcactctgaagcaaggcatcttggtaattcttaagact

SEQ ID NO: 1525 - DNA, 376 bp, Homo sapiens
  Genbank Accession No. AA621430
tttttattgaaatcaaattttatttttggaaaatgacattacacacatcttgcaaatgtacacagaaatgagaatgcgatgaagaacagagcttgagagccaaaataattgcaagagcagctctttggctccctggtattgaatgctgcgaatcttcagcactcacagttcacagcaccttacacacatggcaaacttctctagacaaccttgaagtcctctgacccaagaaagccctcattgaattgaagagggggtgggggaagaggggtgttacaggcacaggagatgaaaagggtctgctccagctggtttatgggggcctcaccaaacctaccagtccaagtggggtcagcaaaccaaaaaaggagaatgc

SEQ ID NO: 1526 - DNA, 382 bp, Homo sapiens
  Genbank Accession No. AA621530
ttttttttaaatttctgttgtttatttttttaaaaaaattaggtaaggtagcaagatatattagcatacaaaatcagtagcttttatatagagagcaataaccagttagaagacataatggcagaggaaatctcatttactagcaaataaattaaatacttagggataagcttagcaagaaatgcacaaaacctacacaaggataattttaaaacactgctaaaaggcacaaaatagacttgaataaatggaaatacatctcctattcttggataggatgacaccacattttaaagatgttagttctctctaaatcagttaatatcatataatatcaataaaataccaatgtaccttaaaaaatgaatttagacaagttgat

SEQ ID NO: 1527 - DNA, 260 bp, Homo sapiens
  Genbank Accession No. AA621535
ttttaatttttcaacaaaactgtccagcaccggcatttcaaacttaatgtactgagcgacttcatgggggacttccacgcacaagtcagcttccatcaggaagatcctggcgatcttctcacatggcccatgcaggattctggaaatcagcgggtactcgcagtcttttaattttgtccgctccccagactcgtgaacgatgtagagtgcgaactcactggggccatcttccaccctaaatttgttcagcagcagggtga

SEQ ID NO: 1528 - DNA, 555 bp, Homo sapiens
  Genbank Accession No. AA621644
tttattcaatagaagccacatacagggacagtaagtttcacctatcatcaaaaaatagtcaaaagaacctctctacactgtaagctcctagaggccatgggtagcggtgtctctgaaaccctgacaaagtctgtaggcagcagggattcaataaatgtgggctaaatgactaataaagccctcaagagcttgtttaaaaaaaagtatcagaaggccaggcacctgtggctcacgcctgtaatcccagcaccttgggaggccgagacgcgcggatcacgaggtcaggagattgagaccagcctggccaacatggtgaaaccctgtctctactaaaaaaaaaaatacaaaaaattagccgggcgtggtggtgggcgcccgtagtcccagctacaatataacattagaacgataaatctcatgccccaaacatgtacataatgtatctgaaagctaagtgaaaactgagtcactttctcatacatggcagtgttttttcttttttttagtagagatggggtttcgccatgttggccaggctggtcttgaactcctgac

SEQ ID NO: 1529 - DNA, 319 bp, Homo sapiens
  Genbank Accession No. AA621752
ttttttttttttttgactgtaaatgtattttattttgtaagtgacaatcaaaatatatttgtgctactgattttttcaaatattaaatgggatcttaacaaaatttgtccactttgatgtattcatgtataactttagaatctgcaaagaccctgactaaagaaacagaagtaattgcacaactgagactgaaggtgttacagtgctgcaaatgatgccagatgtcttacatttagccaagtacaccttcagaggtcccttgattttgagcattaggaacaacagaggaatatacactgaaggcatcattaatagcgtt

SEQ ID NO: 1530 - DNA, 379 bp, Homo sapiens
  Genbank Accession No. AA621780
ttttttaggaataacaaatgtttattcagaaatggataagtaatacataatcacccttcatctcttaatgccccttcctctccttctgcacaggagacacagatgggtaacatagaggcatgggaagtggaggaggacacaggactagcccaccaccttctcctcccggtctcccaagatgactgcttatagagtggaggaggcaaacaggtcccctcaatgtaccagatggtcacctatagcaccagctccagatggccacgtggctgcagctggactcaatgaaactctgtgacaaccagaagatacctgctttgggatgagagggaggataaagccatgcagggaggatatttaccatccctaccctaagcacagt

SEQ ID NO: 1531 - DNA, 486 bp, Homo sapiens
  Genbank Accession No. AA621796
ttttgaccaaaacctcttttattccatttttaaaaataatctcaaatttacattagtagaaagattgatttctgattcttttctttagaaacaccagcaagaaagaggattactcttaacagtagaaaatgacatttttaaatgtctgcaattaaaaacaaagaattacactgcaaagatctttcaaaagtttgaaataagtattgcacataacttgaagttaacttgccacaattcatcacattcaagttttaaatcaccttttaacagaagattcaactcttcaaaacaaaaggggtgaattatcaagtctttccaacagcactctcataaaatgctaaattcattcactgcaagttttattttgcattctgcagaggtctgtgtatggagaagtatatatattataccaaagcgcagggaccagaaggggaaaggagagggttcctttacatagaaaataatcagaaacactttattttacat

SEQ ID NO: 1532 - DNA, 2263 bp, Homo sapiens
  Genbank Accession No. AB000114
gcacgagaagaatttaggaatttctgattcatttaaaggatttacaaattcatcaacccctgaaaactaaagcaaattgaacaggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatggtttcttatgctctttttaaatatagaaatatcatgttaaagaaagtgagtgtatcatttctattaacagtaatttttctaaaaatgaggaaggaagtagcattagcagtaaagacccacaggccacgaccctcctgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgttatttggacaactaaaaaacaccaaactatctcattgcaatttgtattttagcagatttcagcaactatcctaaacaatgttattgtgttccattttaactgggataaatgtttttgtaaaaatacaaccatagaaaggcctctttgttacaaaatgatttgcaaagaaataactgctttgtttgcaagattaaattagtgttggcaaaataaagttctaaagat

SEQ ID NO: 1533 - DNA, 1201 bp, Homo sapiens
  Genbank Accession No. AB000584
agtcccagctcagagccgcaacctgcacagccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcacaccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttc

SEQ ID NO: 1534 - DNA, 4964 bp, Homo sapiens
  Genbank Accession No. AB002304
ctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgggcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacac

SEQ ID NO: 1535 - DNA, 6568 bp, Homo sapiens
  Genbank Accession No. AB002311
cttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccttatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacat

SEQ ID NO: 1536 - DNA, 6143 bp, Homo sapiens
  Genbank Accession No. AB002328
cagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 1537 - DNA, 6336 bp, Homo sapiens
  Genbank Accession No. AB002349
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcaaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatg

SEQ ID NO: 1538 - DNA, 5216 bp, Homo sapiens
  Genbank Accession No. AB002373
ctagttctagatcgcgagccgccgccgccggcgcggaaggacgaggctgaggcgagaaacgaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctgctccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctcc

SEQ ID NO: 1539 - DNA, 1717 bp, Homo sapiens
  Genbank Accession No. AB002533
gcacgagccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaaaaaaaaaaaaaaaaaaaaaaaaaaaaaaaaaa

SEQ ID NO: 1540 - DNA, 1113 bp, Homo sapiens
  Genbank Accession No. AB006781
atctcccactcctgcagctcttctcacaggaccagccactagcgcagcctcgagcgatggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtg

SEQ ID NO: 1541 - DNA, 1725 bp, Homo sapiens
  Genbank Accession No. AB006782
tttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacatt

SEQ ID NO: 1542 - DNA, 110096 bp, Homo sapiens
  Genbank Accession No. AD000092
gatcctatgagcccaggaagtcaaggcttcagtaagccatgatcacaccactgcactccagcctgggcaacagggtgagaccctgtcttgaaaaatgaaattaaaaataataaagaataggccaggtgcaatggcttatgcatgtaatcctagtactttgggaggccaagatgggtggatcacttgaggtcaggaattcgaaaccagcctggccaacatggtgaaaccccatttccactaaaaatacaaaaaaattagttgggcgtggtggcacatgcctgtaatcccagctacttggaaggctgaggcaggagaattgcttgaacccgggaggtggaggttggtgtgagccaagatcccaccactgcactccagcctgggcaacagagcgagactctgtctcaaaataataataataataataataataataataatgattaatagtaataaataaacaattctgcagcatttagtaattcaccatgctgtacagccattagatctatgtagttgcagaacttttttatcacccccaaagggaaacctcacacccattacacactccctcctcattcctccctccctgcagtccctggcaaccactaatctattttctctctctgtggaattgctttttctggatatttctttttttttttttttttgagacagaatttcactcttgttgcccaggctggagtgcaatggcgtgatctcggctcactgcaacctccgcctcccaggttcaagcaattctcctccctcagcctcctgagtagctgggattataggcatgcgccaccacacctggctaattttgtatttttagtaaagacagggtttcaccatgttggtcaggctggtctcgaactcctgacctcaggtgatctgcctgccttggcctcccaaagtgctgcgattacaggcgtgagccacatgcctggcctttttctggatatttcctataaatgggatcgtatgctctgtggcctcttatgactggcttatttcacttaacataacgtttctgaggtttatccatgttgtagcttgtgtcactgcttcattcatttttatagccgagtaatattccattgaatggtagatgcattcatccactggtgaacattgggttgtccatctttcatctgttgtaaatagtgctcttatgaatgtgggtgtacaaatatttggctggacaactgctttgagttatttaggatatacgtctagaggtggaatttcttggtcatatggtagctctatgtttaacttatagaggaatcctgcatgggctttcgagcaagctaactggctgtatgtgttaatggcagctcagcatggggaaaattgccaattctattcccaggccagccacactttggcagatgttccagatgtctagtggagagtcctaccccaatggccacacatgtgttttctctgaactgcctagtatttttcaaaaatttgggctgggcctgatggctcacggctgtaatcccagcactttgagagactgcggcgggtggatcacttgaggtcaggaagtcgagaccagcctggccaacatggtgaaaccctgtctctactaaaaaaatacataaaattagccaggtgtggtggtgcccacccgtaatcccagctacttgggaggctgaggcaggagaactgctggaaccagggagacaaagattgcagtgagccgatatcaaaccactgcactccagcctgggtgagagagtgagactccatcttgaaaaaaataaaaatagataaataaaagaagcaaaatataaaaattgaaagatttttgcttcaaaatctgggtttgggccttctcttgaaaaatcagaagttctagggctgggtgtagtggctcatgcctgtagtcccagcactttgggaagccaaggtggcaggattgcttgagcccaggagtttgaaaccagtctggacaacatagcaagaccctgtctctacttaaaaaaaaatagaagaagaagaagttctaataatactgtggtggaaccagctgagtgggggtggtcctgtgatattgggtacctgccccttcgtcatccatggcctccaccctggtctactggcccctgaagacgcttaagtttgtaatctttatttcaaattgtgtctatacagtcacacagatatatacacatacctttcctttatgtatatatttaaaaggaatctcacaatatatgccatttgtttaattttttgaataggtaatggaatgacatcactcaaaatctaaaactctaaaaaaaggtatttatctctcattgtttgtaggattctgttattccttttaatcaaacttgttaattgagtgattcaaatcttccatctccctattcatttatcttgcctgattaatctaatagtttctgagagaaatgtgaaaccttattttaagcaaattctccttgtaattctgtcaattttttttttttttttgccattttggtttttatttgattataggtaagagttccatacaatagtgtgcgaagtattgcaaacaataaaggaaaaatacagcataagatacctcttacactctgcccaattctgtcaatttttatgtcagatatttttaggctacattctttggagcatataagttcaatatttttatatatcatagatctttttatgtaatatctatgtaataaatctctttgtccctaagaaaaatcaaaataattttcaagaaagatatacagtgaaaaaaatcttactcctaccttttttccccattgccctatagccctgaaatatgattacatagttttattttgccacttttttttttttttttagacaaagttccactcttgttgcccaggctggagtgcaacagtgtgatctcggctcactgcaacctctgcttcctgggttcaagtggttctcctgcttcagccttccaagcagctgggattataggcaaccaccaccacgcctggctaagtttttgtatttttaatagagacagggtttcaccatgttggccaggctggtctcgaactcctgaccttcaggtgatccacttgccttggcctcccaaagtgctgggattgcaggtgtgagccaccacacctggcctttgccacatttttttgcacataaacgtacaatacatattgcctattgcatttttacacttaataaaatagaggactttctaaatccatagacagagagtttcctcattatttctaacagtggcacaatgtttctttatctaactaccccacatgtgtttgtttggctaatttaacgtatggattattatttccaatctcacaatgagcaagatagtagatataccatttttcacatgtgcaagtatatctgtagcataaattcaaaagtaaaattgctgagtcaaagggaacatgtatttgtaattctgatctgtatcaaacagtaatttacactcccaacagcaaagtatatatgttcacctacatatttgcccatagaggatatcaggttttggagttttttctcccaatctgctaggtgaaaaatggtattttgtggtagttataatttgcctttctgttattgtaagtgagattgagaattttttttttttgagatggagttttgctcttgttgcccaggctggagtgcaatgccacgatctcggctcaccacaacctctgcctcctgggttcaagcgattctcctgcctcagcctcctgagtagctgggattacaggcatgtgccatcatgcccagctgattttgtatttttagtatagatggggtttctccatgttggccaggcttgtctcgagctcctgacctcaggtgatccaccagcctcagcctcccaggtgatccgcccgccttggcctcccaaagtgctggggttacaagcgtaagccactgcacctggccaagaatcttttttttttttttgagacagagtctcgctctgtcacccaggctgaagtgcagtggcatgatctctgctcactgcaagctctgcctcccgggttcacgccattctcctgcctcagcctcccaagtagctgggactacatgtgcccgccaccatgcctggctaattgtttcgtattttcagtagagatggggtttcacagtgttagccaggatggtctcgatctcctgaccgcatgatccgcccaccttggccttccaaagtgctgtgattacaggcgtgagccaccgctccaggcccgaatcttttagtatgtttaagagctgtaactctggctgggtacagtggctcatgcctgtagtccctactctttgggaggccaaggcaggcagattgcttcagcctaggagttcaagagcagcctgggcaagatggcaaaaccaaaatactaaaattagcctggcatggtggcatgtgcctgtggtcccagctacctgggaggctgaggcaggagaatcacttgagccctagaggtggaggctgcagtgagcaccactacactccagtctgaatatcagagtgagaacctatctcaaaaaaaaaaaaaaaaaaaaaaaaaaaaaaagctctaactgtaatttacttacctcacccacttttttctcttcaattgttaggcttttgttattgatttttgggaactctttatatatttatatattaggatgactattttgttggtttcctgctatcttttctagtggaagaagatgagaatatgtcttcagagtcagtcttgggttcaagtcctaactttctctttcattatggcacttggatgaaggactctttcattctgtgcctcagtttccccatgtgtaaaatgaaattaaaagcatcctgctctcatgatgatgatggtggtgtggtctccatctttttcctgaagggccgcagcagcaaggccaagaaaccgccgggggagaatgacttcgataccatcaagctcataagcaacggtgcctacgggtgagccacccggggctctggcggggggagggtggcggaggccgggtgtctcggaggtgacggccggtcctcgctctctccccctgcagcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggtgtggctgcctgcggggctgcagggaagatggggccgtgctcactggtcagggctgcggggtggcctgcctgagccgcagtctccatattgattagtcggcctgtatgtttatccatctatttatttctccagtcattgatttgtccatccattctacctatatatttattcagtcatctattggtttatttgtttttcatttcattcagcataaaaacattcagtctgacccattatccatccatctatccttctatctactgatgtgctaatccatctgtttttccatccatacatccatgaacctgtttttatttatttatttatttattcatttattcatttatttattttttgagacagagtcttgctctgtcacccaggctgcagtgcagtggtgcaatctcggttcactgcaacctccgactcccaggctcaagcgattcttatgcctcagcctcccgagtagctgggattatgggcctgtgccaccattcatgggtaatttttctatttttagcagagacaggatttcgccatgtttgccaggctagtcttgaactcctgaccttaagtgatctgcctgcctgggcctcccaaagtgctgggattacaggcatgagccactgtgccaggcctattttattttatttatttatttttgagacaagatctcactctgttgctcaggctggaatgtagtggtgcgatcacagctcactgcagcctcaaatgcctgggctcaatcaattctcccacctcagcctcccaaatacctgggattataggtgcggaccaccacactcggctaatttttgggaggccaaggtggggagatcacaaggtcaggggttcaagaccagcctggccaacatggtgaaaccctgactctaccaaaaatacaaaaattagccagatggcacactcctataatcccagctactcacgtggctgaagtgggaggattgtttaaacacaggaagcagaggttgcagtaagccgagatcgtgctgctgcactccaggctaggctgagatcatgccattgcactccagccctggcaactgagcaagaccctgtcccgcaaaaaaaaaaaaaaaaaagttttttgttttttgtttttttttgttcgtttgttttgttttttatgcagtctccctgtattgcccaagttagtctccaactcctgggctcaagcaaccgtcctgcctcagccttccaaagtcctgggattacaggcacgagccaccgagcccatcccatatacctgtttattaatccacctttccatccatccctcacatcccgcaatttgtctttgtggttgtccatctgtttatccatccgtatgtctgtttaccattatacacctatttttcttttttttgggggggacggcgtcttgctctgtctcccaggctggagtgcagtggcgcaatctcagctcactgcaagctccacctcctaggttcacaccattctcctgcctcagcctcctgagtagctgggattacaggtgcccgccaccatgcccgactaattttttttgtatttttagtagagacggggtttcaccgtgttggccaggatggtctcgatctcttgacctcatgatccgcccacctcggcctcccaaagtgctgtgattacaggcgtgaaccaccacacccggcttatacacctatttttcctttttctttctttctttttttttttttttttgagacagagtcttgctctgtcaccaggctcgaatgcagtggcgctatctcggctcactgtaacctccaccttccaggttcaagtgattctcctgcctgagcctcccgagtagctgggattacaggtgtgtgccaccacacctggctaattttttgtatttttagtagaaatagggttttcaccatgttggccaggctggtctcgaactcctgacctcaggtgatcctcccacctcagcctcccaaagtgctgggattacaggcgtgagccatagcttgcggcccatatattgtttttaatccatccgtgcatgtattcacccaaatgttaatccatctattgtccaaaaccacacatgctgtggctattatgacacatacatgatccctggggcctcagctgtgcctcctccaagccttccagtcaaccatccagtcactcaacgaacacctcctcatcatctccctcgtgtcacatgctgtgctaggtgccagtgacacagaggagacccaggcacagacatctccccgccatggagattccattctggtctgtatagacagacaataaacaagcagagcaagccaaagagataaggacatttatttatttatttatttatggagtctcgctctttcacccaggctggagtgccgtggcgcaatcttggtgcacagcaacctccatctcccaggctcaaggattctcatgcctcagcctcctgagtagctgggactaaaggcgcgcctccaccatgcccagctgatttttgtatttttagtagagacaggggtttcaccaggttggccaggctggtcttgaactcctgacctcaggtgatcagcccaccttggcctcccaaagtgctgggattacaggcatgagccaccatgcccagccagggcatttcatagtgaggacatgaggtccatgaggctggaggaggtgatggggaggcaggcagggagcttctcagaggcctggattatgatggaataagtgacctgctagtacaaagtctcttaggtgacaatttagatttggaggagtggcaagcaggcccatggagccgaaggcaagtgagcaagggaggggagatgaggatgaaggggcgctgatgaggagggtattccagagactggaatggcattggatttcattctgaatgcaacagaaggtcactggagcattgttgtttttttctttttctttttctctctttctttctttctttctttctttctttctttctttctttcttttttgagatagagtctcgttctgttgcccaggctggagtgcagtggcgcatcctcggctcactgcaacctccgcctcccgggttcaagcgattctcctgcctcaacctcctgagtagctgggattacaggtgcccgccaccacgcccacctaatttctgtatttttagtagagatggggtttcatcatgttggtcaggctggtctcaaactccacacctcatgatctgtctgcctcggcctcccaaagtgctgggattacaggagtgagccaccgtgcctgcctttttttttttttttttttgaaatggagtctcactcacgctgtcacccaggctagagtgcaatggggtgatctcggattactgcagcctccgtctccaaggttcaagtgattctcctgcctcagtctcccgagtagctaggattacaggcgtgtgccaccacatctggcaaatttttgtacttttagtagagacggattttcaccatgttggccaggctggtctcgaattcctagccttaaatgatccatcagtctcggcctcccgaagtatggggattacaggcgtgaatcactgcgcccagccttgttttgttttatttttagtgcattgtccaggctggagtgcagtggtgtgatcacagcttactgcagccttgaactcctgggctcaagcaatcctcccacctcagcctccaaaagtagctgaaactacaggcaggcaccaccatgtccagctaatggagggttttaagaagatttgatatgatcagatttatgttttaagaaaatccatttggaggcccattatagtagcttacgactgtaatcccagcacttacagtgggagaccaaggcaggcagaacacttgtggtcaagagtccaagatcaacctacccagcatggtgaaaccctgttgttgttgtttttttcttttcctttttttttttttttttgagacagagtttcgctctggctaaactcgttgcccaggctagagtgcaatgacgtgatcttggctcaccgcaacctcctcctcccgggttcaagcgattctcctgcctcagcttcttgagtagctggaattataggtatgcaccaccacacctggctatttttgtatttttagtagagatggggtttctccatgtcagccaggctggtctcgaactcccaacctcaggtgatgtgcctgcctcggcttcccaaagtgttgggattacaggcgtgagccactgtgcccggccaatgaaaccctgtttctactaaaattacaaaaattagccaggagtggcggtgcacgcctatcatcccagctactcgggaggctgaggaacaagaatctcttgaacccgggggcagtgagtgggcagaggttgcagtgagccgagatggagccactgcactctagcctgggtgacagagccagactctgactcaaaaaaaaaaaaaaaaaaaaaaagagaaaaagaaaaaaattaagaaaagataatccatttggctcttgtggagagagcagaatcaggagactaggaggtagatgactgctctagtccaggttcattgcagaggaggaggagagaagggggccaaatcagtatctctatggtgggtctgtgtgcacaatagatgtgctcaaatgcagattcctgggccccaccctcagagagtttctgaaaccagcaaaatctcgcagaaaagagaacagaaaaaagaaagaaatcattagctttcttggtcattggtgattgaaaaaccaatattaccttcaggaatggctggatgtaggtgctcaaaccattccatcaggaaactctccatctcttggctctgtactcccacatgtgggcttccttctagacaagccctcatgtagcaaggttgccatctagcagatctcagcttacattctatgagcttagcaattcttacaggaaaagagtgaaaattccaagggctaactcactggagcaacttgggttacatactgccccggttgctgcacatggaaggaaatctagcctttgtaggataaaaaggaaatagatattgagaaactgaaataccaatgccaattacagtaaatctggcagaggggcagaggcagtggccaacactttgggaagctgaggcaggaggatcctttgaacccaagagttggagaccagcttgggcaacacaatgaaactcgtttctacaaaaaacttttttttttttttttttgagacggagtcttgctctgtcacccaggctggactgcagtggtgcgatcttggatctctgcaacctctgcctcccaggttcaagccattcttctgccttagcctcccgagtagctgggattacagccgtctgccaacaagccaggctaactttagtattcttttttcagagatggggtttcaccatgttgaccaggctggtctcgaactcctgacctcaagtgatccacccgccttggcttcccaaagtgctgggatttcaggcgtgagctaccatgcccagccttgaacaattttttaaaaatcagctgggcatggtggctcacatctgtagtcccagctactcaggaggctgaagcaggaggattgcttgagctgggaggttgaggatgcagtgagctgtgatcttgccaccgcactctagactgggcaatggagtaagaccctgtctcaaaaaaaaaaaaaaaaaatctagtgaagaccaagaatctgcatctaaggcttccagctccaaggttcagacaccaggagatagagggctgtgcttccagatgcagttgataagtgggtagcctttgttccccaactaaacctcacctctaccaacaactgcctgcatgacccatcctttctttgagtctccatccctttgtgtataagatgagctgatgacaccaactttggaggatggctaagaggacaagaagaacccagtagaggacctggagggagggaggcccctctcagagcctcagtttcccttatctataaaacgggtacaacataacatgagaagttggtgctatggtgcatgtccagagagaggaatgcctccctttttatgcgggcccatttcctggcctgcaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaagtgagctttgatctttcccatcactccctctgtccctcgggaggccaggaggcagaatggacgggcctcatccctgagatccccacctgtgcctacagcctccttatcacctccatgggtcacatcaagctcacagatttcggcctctccaagatggggctcatgagcctcaccaccaacttatatgaaggccacatcgagaaggacgcccgagagttcctggacaaacaggtgtgtgtgcgggcatgggggtcgctgagggtggagtgaccctgcaggacctcgggaacccagggcctggtggggggcacagctctcccttgagggccctcctctggctggggcgtgggctgacagcctgcccccaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtggtacgtggcttggcagtgtacaggggcagagtgtggtgtgcacggagagatggacaggctcagggttccagggatttcaaaagcgaccccccagaggatcgcttgcactcaggaggtcaaggctgcagtgagccatgatcgtgccactgcactccagctgggtgacacagtgagatcctgtgtccaaacaacaacaacaacaaaaaccgcccctaagttccgttttgttttgcagatgacatcctgtggcccgagggggatgaggccctacctacggaggcccaactcctcatatccagcctcctgcagaccaaccctctggtcaggcttggggcaggtaagtccgccatgcagaggagctgagggcccactgatagagagcaggcctccaaaaccccaggcccagcctgtgctgtggccccggggcggaagacatggggggcggggctgggctgctgggttggccatcagctgtggctggaatcccttccgtcccaggcggcgcttttgaggtgaagcagcacagtttctttcgagacctggactggacagggctgctgaggcagaaggccgagttcatcccccacctagagtcggaagatgacactagctactttgacagtgagctgggacaccaggcacgacctgggtcgaggggtgggatccgggaagagggaccctggggtaagtaaagcctgggatagggcctggctaagtaccaagatgtgatgcctaggtgcgaaggtggtattttggtgggggcggggccaagtggggcggggctgacatacaggcggggctcaggctgaaatgtaggtaagaacctgagattgggctaggtgtggggcctggcctgggtgagttgtgagtgtgggcctggaactgaactagagagaggtactagcgctcagaatggcctggggtgatgccagggtgcagagcactgtaggtggagcgtggcctctttggaggcggggctagacggtgccactgagaatggggcaaggaccttgcctgggagcggagcctaaattaaatacactaatgaggcaggggcgtggcctgacctgaagacttgtaaacccgtcttgaaccaggactgggctcctgtggggatgtgatatgaggaggaaccccgtaccctcagtcacagcccatacccgctccccagcccgctcagacaggtatcaccacgtgaactcctatgacgaggatgacacgacggaggaggagcccgtggaaatccgccagttctcttcctgctctccgcgcttcagcaaggtgggccaagtctgggtgtgggacagggcgagaccccaggagggatggggcttggagagacagtgagaaacaggttccctggtgcccaaggtctcaggagcgggaagttattgatggggcgggagtctggaaggtggtaaggccacgcaagaggcaggttcgggagtctatgggacgggcctttggcactgagtggaatctaacaggaatcaggacagttgtgcagattgaggccatggtggggcggggctaggtgtgggtggggcggggtcaggacgtgggaatgaggccagcagcgaaggcggagtaaagcccagcgaagtcttgcttttatttatttatttttattttttctaataacgggcagagaagccataggccttgctttgagaagcaacttgtagaggcgtgcagggcctagcctgggctaaggagacataaattaagggggttgctgggaagatggggctgtgtagagagcagattggtcagggcatcgtcggggcagagcctagaataaaacgcagtgcctaactttgtggtgtggggcctgaactgaagaattgtaggttgggggatcatgcacaattgggcggagcaggcctcggagggtggagtgcgttttgcgggggatccactgccaggaagctgattagctccggagtgaaagtggaacccgggctggacttgcctcccaccaccacctacaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatgtgagcaggggaatggcggagtttgggggcggggtcgaagggggcgtgtcttccataaccacgccccctccatgcagcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccagtgagtgccctatcgtgctgccttccccaatcttccccaatgtcctactggtcatatagtgagcatcccacgagcctggtgctgtttatgaaagatctcaggtcctattcacattgcaatttgggatttttttttttttttttttttttgagacagagtctcactccatcacccaggatggagtgcagtggcgtgatctcggctcactgcaacctccacctcccaagttcaagtggttctcgcacctcagcctcccgagtagctgggattacaggcgcgcgccactacccccggctaatttttgtatttttagtagagacagggtttcttcatgttggcaaggctggtctcgaactcctgacctcaagtgatctgccttccttggcctaccaaagtgctggggttacagtcgtgagccaccacacccagcccaatttgggattcttaacattagaaacaccccaataccatggtcagtcagtgatacagaccgatacagactatgtctctatatgaggagcagtgaggcatgcaggttacctgctcagatgaaactcaccatccatcaagggtaaaaagtggaaagagcattccaggcagggaaacagtatgtgggaaatccctggccttggactaattcctaacacacttgctttctgttgcagctgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcaggtaatgctgggccccacctggcaggggaggggctgccccccatttgaggcaggacagaccaatgaaaatgctgcattttccctgtccaccgtgattggctccaggctggaccaatgagaggctgctctgccactgccttgggaggagggaggagcagatacagggagatgtctatcttcttggttctgatttctgaccatggttgtgtgtctgtagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctgggtgagtactcatgggtggagtctccatcacagagtggagggtggtggggaaaaggcccctccagctcaaaccagttagcctgggtgagacacctctgtgaccctctatgcctcttccctctctaaacctgtttcttttttcttttacttttttattttaggcggagactcactgtgtcgccaggccggagtgcagtggcaggatctcggctcactgcaacctctgcctcctgagttcaagccattctcctgcctcaaccttctgagtagctgggactacagacaggcgcgcgccaccacgcccagctaatttttgtatttttagtagagacggggtttcaccatgttggctaggatggtctcaatctcttgacctcgtgattcacccacctcggcctctcaaactgctgggattacaggcgtgagccacggtgcctggccgagactgtttcttcatctgcaaaatggggagaataggccaggcgcagtggctcaggcctgtaatcccagcactttgggaggctgaggtgggcagatcactggaggtcaggagtttgagactagcctggccaatatggtgaaaccctgtctctattaaaaatacaaaaattgggccgagcgcggtggctgtaatcccggcactttgggaggccgaggagggtggatcatgaggtcaggagatcgagaccatcctggctaacatggtgaaaccccctctctactaaaaatacaaaaaattagctgggcatggtggtgggcgcctgtagtcccagctacttgggaggctgaggcaggagaatcgcttgaacccgggaggcggagcttgcagtgagccgagattgcgccactgcactttagcctgggcgacagagcaagacaccatctcaaaaaaaaaaaaaaaaaaaaaaaaaatggccaggcgcggtggctcacgcctgtaatcccggcactttgggaggccgaggtgggtggatcacgaggttaggagtttgagatcagcctgaccaacatggtgaaaccccatctctactaaaaatacaaaaaaaattagccaggcgtggtggcagatgcctgtaatcccagctactcaggaggctgagacaggataatcgcgtgaacccgggaggcggagcttgcagtgagccgacatcgcgccactgcactccagcctgggtgacagagcgagagactccgtctcaaaaaaaaaaaaaaaaaaaattagccggaggtagtggcgcatgcctataatcccagctacttgggaggctgagggaggagaatcgcttgaacctgggaggcgggtgttgttgcagtgagccaggattgcgccacagcactccagcctgggtgacagagtgagactccgtccaaaaaaaaaaaaaaaatgtggggggaggaataataactatttcacaaggtgttatgaggattctaatgcatgcagagctaagtgtcctgcatataagtttaggagctttccttgttaccaatcccactaaccctgtccctatggggtgctcttttcccagcatgtggaggaaggaggcccagcccaggaggcaggactctgtgctggggacctcatcacccacgtgaatggggagcctgtgcatggcatggtgcatcctgaggtcgtggagctgatccttaaggtgagtgcagggaaggaggcaccctgggcggagggtgggggaggcctgagcagcccctagcagagcattttcccgcattcttcccccagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagaggtgggcacagccgtaaacagcctggtctttgagcagtgggtggaacttaggcgggaggggcacagatgaggatggagaagggaagagcacgggaaaggtggcgggaacaaatgaccaacaagcaaagggaagaggacaattaagaggggctgcgggctgggcgcggtggctcacgcctgtaaccccagcactttgggaggccgaggcgggcagatcacgaggtcaggagtttgagaccagcctggccaatatggtgaaaccccatctctactaaaaatacaaaaattagcctggcatggtggcgctcgcctgcagtcccagctacttaggaagctgaggcagaagaatcccttgaacccgggaggtggatgttgcagtgagccaagattgtgccactgcactccaacctgggcaacagagtgagactccatctcaaacaaacaaacaaacaaacaaacaaaaaaagaggggctgggatgagtcacacctgtaatcacagcactttgggaggctgaggcagaaggatcacttgagcccaggagtcaagattaggggcaacatagagagaccccatctctacaaaaaacttaaaaaactagttgggtttggtggcacacacctgtggtctcagctactcggaggctgaagtgggaggattgcttgagcctgggaggtcgaggctgcagtgagctatgatctcaccactgcagtccagctgtgacaacagagctagactctttcaaaaaaaaaaaaaaaaaaaaaaaagaggggctgtaaaagtggaaggagccaagaatggaagctgtgccaaatttctaggatcagagaaaagcattgtaggagggtcttgcacatataggcaggcccaggagatgtgaactggaaagggagatgtccagagacggagggggtccaggagatggtcctatcctgttagatgtgtttagacagaactgggaaaggctagaataagaaatgtctatctggaatgagcatgccaggcaaggttcagccaactgaaatcctattttcccttatagataggaggagctaggtgggaggtgggtggggccagaagggtattctgtttgtttgtttgtttttagtattctgttttgatcagtgagtttggcccagacaagtacagggatttgggtgagaggagccagacggggttgagataagtacatttcttcccactcttataggtgggttgtagtggaagaggcgggactagaggcaggtgggaccaagttggttttgtttggatgtgtttctagcctggactgggagtggccaaaaggttgggcaggacctgaagtgggaggagggaggagccaagcagcactgagttaagggaagttctgtcttgataggtgggttgtagtgaaagacggagggactagaggggtgggcaggactagaagaggttgtttttggccgggcgaggtggttcacacctgtaatcccagcactttgggaggccgaggtgggtggatcacctgaggtcaggagtttgagaccagcctgaccaacatggtgaaaccccatctctactaaaaatacaaaaattagctgggagtggtggctcactcctgtagtcccacctactcaggaggctactcacgaagctgaagcacggtaatcgcttgaacccgggaggtagaggttgcagtgagccgagatcgtgccattgcactccagcctgggcgacaagagcgaaacttcgtctcaaaaaaaaaaaaaaaaatggttttgtttggatgagtgtttgtagccagaattgggagtggcctaaagttgggcggggcctgaagtaggaggagctaaaggaagttctatcttgataggtggattgtagtggaagagggaggagctagagaggtgggcggggcagaacaggttggttttgtttggatgcttgtttctagcttggactaggagtggccaaagggggtgggtggggactgaagtgggaggagccaagcagcactgagctaaaggaagttctttatcttgataggtgggttgtagctggagagggaagggccagaaggggtgggtggttaccgttgtgaggccgtgaaatgggaggagccctgagctctggcgtccaggtcaaggacgcttggccccctccctgtcccgcagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggtattacctcctgcacctgcgcggggaccgagcagcgcggggtggcctggctggtgcttgggctgtactcactcgcttcacctcctgtctcccgcaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcaggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtgagttttctggggctcactcctctccaggcaaggcgagacatcacacgaccccacccccatgcccaggtgctttttgggaggtgggactccagttctggttaccatggagagtggagggaattttggatagacacctcctgtggtcccacttctggtctcacctctgcaccaactgcccccaaacctttagggggagaattgaagctgcgatgctcttgtgtcccagcgcccacctgaagagaaggttaacagcctcgtccaccaatttccatttatttactcctcaacaatcctgatggcaggtattatgtttcccattttgcagacaggtagactgtgtcacagagcggttaaggcacacaatcaaggtcatacagctaggaaggggatgaactgggattcaaaatcaagtccaaactggttcctgagcccttagattttttattttttatttttttgacacagagtctcattctgtcacccaggctgaagtgccgtggtgttagctcagctcatgacaacctctgcctcccgagttcaagcgattctcctgcctcagcctcccgaggagctaggaccacagacgcgtgccaccatgtctggctaatttttaaatatttttaatggatatggggtttcaccatgttggccaggctggtctcgaactcctgacctcaagtgatctgcccatctcagcctcccaaagtgctggggttacagatgtgagccactgcacccacccgtcccccgccccccctttttttttgaaacagagtcttgctatgtgacccaggttggcgtaatcatagttcactgtgaccatgatctccctggttcaatcgatcctctggcttcagtggctgggactacaggcatttatcaccgtgcctggctaactttttttaagttctagtagagatgtggtctcactatgtagcccaggctggtctcgaattcctgagttcaagtgatcctccctccttggcttcccaaagtgctgggattacatacgtgagccactgcacctggccataagggttagatcttataagctctgctgggcttcctggccatgccattacagggctggtagttcttcaccagcggctggaaggctttccagagggctggcagctgggcacacagtgtgcccccaccccgttgctcctctccctggttccgattcatgtcacccacgcaggtccagggcccttttggggacacgcaccatttggagtggtcctctgtgctgttgaagcttgggccggctggtccagggaaagctatctggttcacattcagaacctgccagatatccgagcagttagagggcaggatgcctacagttttgtgccagaactggacctgcaggttggtaccaagggctgctgccaaccagccggagtacaggtctgcaaaggatggagagagggcacaggtagggtcagggccactgcgagggagtccctagtccacttcccctctctcagctcagtttccatatttccttttttttttttttttttgacatggagtcttgctctgtcgcccaggctagagtgcattggtgcaatctaggctcattgcaacctctgcctccgaggttcaagtgattctcctgcctcagccttctgagtagctgggactacaggcatgcacaaccatacccggctaattttttaataaagaggggtttcaccatattgaccaggctggtctcaaactcctgatctcaagcaatccgcccacctcggtcttccaaaatgctgggactacaggtgtgtgtcaccgcgccctgccacagtttccatatttctgagctcagttgtcaattcccagtcctgggaatgatgacattaatattaattgcccttcccaaatttgtttttgagacagagtctcactctgtcgcccaggctggagtgcagtggtgtaatctcggcacactgcaacctctgcctcctggtttcaagcgattctcatgcctcagcctcctgagtagctgggattacaggtgcccgccaccacacccggctaatttttgtacttttagtagagatggggttccaccatgttggccaggctgttctcaaactcctgaccgtgtaatcagccagcgccctccaccatgcccagataatttttgtacttttagtagagatggagtttcaccatgttggccagactggtcttgaactcctgggctcaagtgacccacccgccttggtctcccaaaatgtggggattacaggtgagccaccgcgtccggccctgagtgtttttaattaattaacttatttattttgagactgggtctcattttgacaccccagctggagtgcagtggcaggatcatgactcacttgcagcctcgacctcctgggctcaagctgttctcccacctcagcctcctgagtagtggggactacacgtgtgtgccactatgccccactaattaaaattttttttgtagagatggggtcccgctgtgttgcccaggctggtctcaaactcctgggctcaagcaatcctcctgcctcgactgggattacaggtgtgagccactgtgcctggcctatttatttgtatttatttatttatttatttattttgagacacagtctcactctgtcacccaggctggagtgcagtggcactatcttgactcactgcaagctccaccttccgggttcacgccattctcctgcctcagcctcccgagtaactgggactacaggtgcccgccaccatgcctggctaatttttgcacttttagtagagacagggtttcaccgtgttagccaggatggtctcgatctcctgagctcgtgatctgcccacctcagcctcccaaagtgctgggattacaggcatgagccactgtgcccagcctatttatttatttttaaataaagacagggtcttgctctgtcacccaggctggagtgcagtggagtcattatagctcactgcagtctgaaactctgggctcaatttatcctcctgcctcagcctcccaagttgcttggctaatttttaattttgtagagatgaggtcttgctatgtttcccaggcttgtcttggatgcctgtcttcaaatgatcctcctgcctcagcctcctaagtaactgggattacaggagtgaggcaccacctctggcacccaaatgacttacaggtaccacttcattcacaattttttaagtagatgtcagtatccccatttttcagatgagtagaccaaggctcaggtgaagttatacatcacacagcaaaacccagggtttgaacccaggtctgttcactgatcatgtgattatagctcccaaacagacctggtctctaccgctgacttgaactcagccatggccacaccagtcaccctgtctgcagagaaggagctctccaaccctcaaccttgagactcaccatctccaaatttgctgaacttggcaaagctctggaaaacagccccggcctgggatgtgagtgtgatgctgctgttccagggttcttggctaacgtggtggcccttgaccacattctccaagtcggggaattcctgggcaaagatcccttccagctggtagttatagacccaggggtaggtgtaggtcagctgcttgcctggaggacaaggggaggaggaaatgcaagatcgttccaggttctggtcagtaaacccaggactcatcctgtgtccctgactcgacttacccatcttcgagaactgagcgaagggaaaagacacacagagcagggtctgcccgtaggtacaggcgctatgaggccagctgtatgcagcagaggaggccggtggagggaagttaggtacactgtggaccagccagaagcccccatcgtggtcaaggagcaggacacctggaccaaaagaaggcattaggggaggtcgggcgcagtggctcacgcctgtaatcccagcactttgggagaccgagacacacagatcacctgaggtcaggagttagaaatcagcctggccaacatggcgaaaccccatctctactaaaaatacaaaaattagctgagcgtggtggtggacgcctgtaatcccagctactcaggaggctgaggcaggagaatcgcttgaacccaggaggtggaggttgcagtgagctgagatccaccactgcactccagcctgggccacagagcaaaatttcatctcaaacataagtaagtaagtaagtaaataaataaataaataaataaataaataaaaatttaaaaaaagaaggcaggccccacgcagtgtaatcccagcactttgggaagccgaggagggcggatcacctgaggtcgggagttcaagaccagcctggccaacatggagaaacctcatcactactaaaaatacaacattagccgggcatggtggtgcatgcctgtaatcccagctactcgggaggctgatgcaggagaatcacttgaacccaggaggcggaggttgcagtgagccgagattgcaccattgcactccagcctgggtagcaagagcaaaactccttctcaaaaaaaaaaaaaaaaaaaaggcaattagagggtattgctccaggcctcccagcaagctcatctgcaatcaggaacaccctcagtttgcagcggggcttagagagggtgccagcagtgttagaaccacagctgagctcagtttttgcaggcataaattcttatagtccagaataacgccaagagtaatgtaaggtagggaaacaggccaggtgtggcggctcatgccggtaatcgcagcacattaagaggccaaggtgggtggattgcttgaaccaggacttagagaccagcctaggcaacatggcaaaagcccactctacaaaaatacaaaaagtaggccaggtgtggtggctcacgcctgtaatcccagcactttgggaggccaaggcaggtggatcacctgaggtcaggagttcaatatcagcctgtccaacctggtaaaaccccatctctactaaaacatacaacatttagctgggcatggtggcgcacacctgtaatcccagctactccagaggctgaggcagaagaatcgcttgaactggggagatggagattgcagtgagctgagattgcaccaccgaactccagcctgggtgatggagagagagtgccgcaaaaaaaaaaaaaaaaaaaaaagccaggcgtggtggggggtaccggcaggcccagtacttgggaggctgaggtaggaggatcacctgagccctgggaggtcaaggctgcagtgagctgtgatactgcactccagcctaggtgactgggtgagaccttgtctaaaagaaaataaaataggggaaatagatgcccaaggtctgacaggggagatctcccaccccactatggaggtcaggggttagcttggaaaaatgcataggaactcggctgggcagggtggctcattcctgtaatcccagcactttgggaggccaaggcgggtagatcacttgaggtagaaaccaggagttcgagaccagcctggccaacatggtgaaacctcgtctgtactaaaaatatgaaaattagcctggtgtgatggtgcgcctttaataccagctacttgggaggctgagacaggagaattgcttcaaccccagaggcagagattgcagtgagccaagattgtgccactgcactccagcttgggtgacagagcgaactcccaccgtctcaaaaacaaagaaaaaaaaaagttggggggaatagatgcccagggtctgacagtgcagatctccccgaccaccccatgcacgtcaggggttaccttggaaaaatgggacccgagtctctccccagcccccaatccaggcctcacccttcgtgtgcccacgcatggaagagtcctgagccttgctgggttgaggcggttggtcattgtagagcaggaaggcgagctgcgggcggataaacggaggcaacgtgaaattcctcccaggcagggcagccctagagtttcgcccctagttggcccggggcccccttcacctggctggtgttgctccggtacagcggctgcaggcttcggcccacggccccctccgggctgttgatgagtgccctgccgtcccgccagcctccggagctctcgtccagatacttgtactgcagccctctctgcgccgcctccccggaccctctaagagctggcagcttgtagaccacgaacctggaggtcggagaatgcacagaaataggagagagggaagagaaggcaccccagggttccccgaggaggtagccatcccggttgagtgaccgcagccggaccccggggcgatggtaggccccccgctgcgcactcaccagtctacaggctgcccggagtccccgtagcaggtcagggccccggcggggacgcacagcagcgctgccagcagcagcgggatcatagctgctatggggctgagatccaggaatctgtgtcgggactgcggggcgctgggttacatcagaggccaggactggcacctggcgcctttcacttccctaaacttgcctgggaaccggggcggggacatcacgagggtacagactcctcccccgagacgcgatgctgcgttttggagaggcaaaaggcaacgctgagtctgcccagaccacgcccacgacgggcccggcgctccagcgtctcctggagcctggccaccgttccttttcgtggtagctaatcccagcccacgctcttctgtctgacccaactcccgcccgggtttctggatcaggcacaagtttgtattttattttttattccagccctacaacctgggtccaactcttgggacctttgttcttcctcttttttttttttttttttttttttttttttttgagacggagtttcactcttgtcgcccaggctggagtgcaatggcacgatctcggttcactgcaacctccgccttcctgattaaagcgattatcctgcctcagcctcccgagtagctgggattacaggcgcccgacaccacgcccggctaatttttgtagttttagtagagacggggtttttccatgttgactaggctggtctcgaactcctgacctcgtgatccaccagcctcggcccccgaaagtgccaagattgcagaagtgagccactgcgccccttaagaagcatttgtgttccagtgtatcttcccctttttctttctttttttttttccttccttttttttttttttttttcccggacaatatctcgctctgttgcccaggccggagtgcagtggcgcaatcttggctcactgcaacctctgcctccccagctcaagtgatcctctcacctcagcctcccgagtagctgggatcacgggcacatgccactatgcccagctaatttttgtagttttttttttgaaacacggtttcaccatgtggctcaggctgaactcctgagctcaagggatccacctgtcttgcctcccaaagtgctgggattacaggcatgtaatccacgccacccagactctcctttttcattctgcacgttttctccaggatcccctgagctagcaaagaggtgactgtatgtttgttttttgtcgttttgagacaggataatggtttctcacccaggctagaatgcagtgactccatcacagttcactgcagcctcaacctactgggctcaagagatcttcccaggtagctggtactacaggcctgtgccaccacacccagataattgttcattgcagagatgagggtctcactatgttgcccaggctgctctggaactccggggttcaagtgattctcccacctcagcctcaaaggatcatggcagggcaaagggctatgggaatctgagtactggcttgaaactgcctttgcaaaaattatgacagaaaattatgtcagtgaaagagctctgacctaaccaactccatcttgcctttaatctccaaactgcccttgcttggtcattcctggagtggggtcaagctaactttttttttttttttgacacgttgtctcactctgtcgcccaggctggagtccagtggtgtgatctcagctcactgcaacatccgcctcctaggttcaagcaatcctcctgcctcagcttcctgagtagctgggattacaggcatgcgccacatgcccagctaatttttgtatttttggtagagactgggtttcaccatttttggtagagatggggtttcaccttggggctcaggctggtgtcgaactcctgggctcaagtgatctgcccgcctcagcctgccaaattgctgggattaaagagggagccaccatgcctggccccaagctaattttgggaggaatttagtttatagcttaaatgataatagcccttccccaaactaaactgcctttgtagaaataatgaaagggcactaggttaggaggatgagaggagcctgaattctgctaaactgtaggtgtagtagttaaattatgaccagccatttttccggccgggtgcggtgcctcacgcctgtaatcccagcactttgagaggccgaggctggcagattacctgaggtcaggatttcgaaaccagcctggccagcatttcgaaaccccatctcttctaaaaatacaaaaattagcccggcatggtggcatgtgcctgtaatcctagctacctggtaggctgacacaggagaatcacttgaacccaggaggcagaggttgcagtgagccaagatggaacaactgcactccagcctgggcaagagcaagactccatctcaaaaacaaaaacaaagatggccagccattattctggaggtcacaaggtttgcaacttccccagttatttctgcaaataacatgactattgcaaaacctaacgctggcctttttagatgtctttttaggctttttgcatatctgacaactggatgactccacccagactagcgactctatggtccccacccagaagctgactcagcaactgttttccacagctccaggattgcagcaaggcacccattccctagccctcctgcccaccaaactgttcttgaataaccctagcctctgaattttcagggaggctgattcaagtaataaaactcccatctcccatttagctggatgtatgtggattaaactctctctattgcaatccctctgtctcgataaattggctctatctggacagtgggcaagatgaaccccctgggcagtcataggctgtgaactcttaaatccagggagatgtttgctgtcaatgtccgcagggttcaaggcagaagacaaggacagtgtagcctgaactgggtgggaaaagagaggacagcaaggcctccagtgcccaagggggcttgttggagttgaggggtgtcactgtagtttaggagatgagggtgtgtaaggccctctaatatgacctctaggtttacagcctcctgccatcttccagcctccaaaacccaaaaattcaggccaacgctgaagctttatctgggaggggcatttttataggacccataaccattgacagttaatatcagccacaataagggaccttcaggagccgctttctagacccagggtctctgggaagcctcatcccacaccctctcctgctgtccagggccatctgggagctggtctgagtgtccactgagtccgtttatttggcggtctgtctcactgggtttgcacgacagtttggacatctctgtgtggctccctgtggctgaaggcttgtcggattttccgtaagaggctcccccagggctgtctatgggtccgtgtttgatatttgggtggatctttgggaacgcgagtccaggagagggtccattcgtgggaaaaccacccagcattgtgtcacgcgcgtccgtgtgaagagaccaccaaacaggcttcttgtcccatccccagtcactaggagagtccaagtgccagggcagggctcaaaggtggcgcttcatgtgcaaggccaggtggtcagagcgcgaaaaagcacgtgggcagagctggcagcggaaggggcgctgccccgtgtgtttccggtagtggcgggtcagctcgtccgagcgcgcgaatctccagccgcagccttcccacgtgcaggcgtatggcttctcccctaggggacaaggaagccataagcgccactgtctgcccagtcatgtccccgggtcccctgcatctggccacacccctttactcagcctgggctgggactaggatgaacaaagtgaggcccctagggcacaaaatttaaggaggcactcactctcagaggccagccaagtccaagtcccgccctctgcaacccttcttcccctgtaactacagcgggcgccgcgccctttctcatgtccggggccccgccccctcacctgtgtgcgtgcgcagatgcgccttcaggtgggagctcttggtgtagctcttgccgcaacccgggtgcgcgcacgtgtgcgctgcctgcctcttgcgcgcccacgaacgtcggcctcgcttggatggcgcggtctcggctatcacacctggatcctctgcagtccccccgagtccagtgcccaccgtcccgggtcccaaacaactcaggaaggagggggacgtggcgggaccgggcgcgggtccctggagcccgcggaagagctggaagtgcccttggtactgaggcgccgggtacatcgcggggtacccggacagtagcccgtagggggcgcccgacgccgcaggcactgaaagcccggtccgcgggaagtagccacccgaggagccggcgccgggccccgggtacaccggttgcagcgccagcgccttgggctcgggggccggggctggagccagggctgggcccacgaaggcgtcgggagcccgggctcgcagggcagggcgcacccaacccgagtgatcctccgaacccaaaagcccagccaccagccccgggccgccagcatatgcgcccagagtctcgggcggcggcggatattgcgccccggaggcctcgctgggcgccagagcgcaggtctggggcgcgccaccgggctccgggcccgagaagttggtgaggaggagatccaggtcccaggtggcgtccgcgcccctctcatcgtcctcttcctccccgggctggtcctcagacttcacgtggaggggcggctccgtggggtcaggaggacccgggcccatgtcctgcgcctcttcggagcgccaccactgcgggagggagcaggcagctcgaggttcggtggacactggggtgccctgcccagggacatcgcgggctggacactctgacgcagaggctttggaaaggggtcttgtttgcctgtctgtctgtcccacttccccaacactgcccctctaaccgcccctctccccgctccccccccagctccagggacagaaaccgatcaggtctggctggagacaggagataagacttccactatctggaaccacactcggggatgggggaaggggtagcagagctgctggagatggaaaactggcaggggacgggggagaggatgccagccttgacttagttttcccccagaacatccctctccttccctgtctcccaaaacaagattaattccgaaattttggatgtcccccagacacactcatcatttcccgctgatatctggaagattgtctgtgagcctagatctcgttcctttttttttttttttttcttgagatagggtcttactcttttgcccaggctggagtgcagtggtgcagctcactgtatccttaatctcctgggctctaatgatcctcctgcatcagcctacggagtacctgggactacaggcacacgcccccatgcctggcctaatgtttttggtattttttgtagagatagggtttcaccatgttgcccaggctaccttcgttttctattaccgaaatagatcacacttagaacctcaaacccctagaccaccctcctcaccccctgccagactaagctgagatctcctctcctggactgagcgtacctcagtcctggttaagtctcttgatttcaggtcaagatgcaggtctggaccccaagatctgtgactgtggccctggattccagccagcccacctagaccccaccttctaggccccaccttgaggaagtcatcctgtgtgtccgggaaggggcccagggcggtcagtgtgctgatggagggcaaggcggtctcggctgtggccatggctggctggtgcccaccctgggcctcaagcctcctcttcctcggctgcctcgtgaactctgaggctgtgatagccccttcgagggctcctctctgtccttagctgattggctgcagcctctgataaggcaaagcaaggcaaggcggcgggggggcactgtttctggggcacaaacttcacgttggcctgtctggggctggggttaaagactaaccctgtgtccaaagccaagtcaaatatcaagggttggggggttcagggtttgagggtccaggtgctgggtaaaaacagacattgggtctccaaagaaggagagacttgggggtcttccctcagttaactttcctggaaaaggcagaaagggtattctgggaagaagctgtgggaccccctgtccccctgattgaggctccacagccctccccctccccagtaaacagcaacaaccgtgctgatggcgggacttggcacgagctccccgccaagcattatcagacaccccagacgttggaggctgctatcaggtgggggcccaggccagctagagctctgtcctccggtgaaggggagggctgggagttgggtcttcaaattagcctggcgttcaatttgcctgggttgggacctcccagggtctcagccctgcagcaggaggaagcccctgacaactggcccaccattgtctactggggacccttgggtggcactgcatgggactgcatggaggctggttcagtgccagctgctttagtgcgatgggggcagccaagggaaaagtgaccctctctcctcctgggtgggataggaccgttggatcaagccacaggcagtacctgacctgcaggagaccagtgccctggctctgggcctggctgctccttgattctgcccaacatgaggagaggatctgagtttctacaacaggaacctccactctggtgccctgggagcctgggaaggggacatggatacgtattacagacacataactcatagtcactcattggaagactgaggcaggaggatcacttgacaccaggatttcaagaccagcctgggcaacataaaacctatctctccaacaaaaagctgtgagtggtggtgcatgcccatagtcccagctactcaggaggctgaggtgggaggattgcctgagcccaggaggtcgggactgcactgaactataatcacaccactgcagtccagcctggggcacagaaagcaagactctgtcgctggaaaaaaaaaaaagttgggtggccatctttattcctggcagatcaacctgggtgacacaaacaaaaacaaggccaggtgcggtggttcacacctgtaaccccagcactttgggaagccaaggtggggagatcacttgaggtcaggagttcgagaccagactggccaacaggatgaagccctctctctgctaaaaatacaaaaattagctgggcattgtggcacatgcttgtaatcccagctatttgggaggctgagctggagaactggttgaaacttggaggcatggggccaggcgcagtagctcacgctagtaatcccagcactttgggaggccgaggcaggcagatcacctgaggccaggagttcgagacaaacctggccaacacagtgaaaccctgtctactaaaaatataaaaataggccggggatggtggcatacacctctaatcccaggtacccgggaggctgaggcacaagaatcacttgagcctgggaggcagaggttgcagtgagccaagatcatgccactgcactccagcctgggctacagagtgagattctgtctctaaaaaacaaaaacaaaacaggcttggagcagtgagtagtggctcatgcctgcagtcccagcactttgggaggccaaggtaggaggaatgctcgagcccaggagttcaagaccagcttgggcaacatagcgagatcccatctctaaaaacaaaaacaaaaacacagttactcacaggaccatgcaattacataatgacatgagttcctgttccctcagtcacactgatcatataatccgtgcacatataattgtgtgtctgtctatgtatatggactatgcacagacatacaattcccaggcactaaaacacaaccctatgctatattggttacacaatgtcatagccaaacaatctctaaaacacagaattcataatccacaggcaggcacacagttatacaatcctactgacacaatttagccgtaattgagcagacacacatggggagtcagatacattgtcacagaactttttttttttagatagtgtctctctctgtcacccaggctggagtgcagtggcatgattttggctcactgcaacctccacctcctaggctcaagtgattcctctgcctcagcctcccaagtagctgggattacaggtgcctgctaccacgccacgctaattttttttttttttttttttttgagacagagtttcactcttgttgcccaggctggagtgcaatggcatgatctcagctcactgcaacctctgcctcctgggttcaagtgattctcctgcctcagcctcccgagttgctgggattacaggcacccacaagcaggcctggctaatttttgtatttttagtagagatggggtttccccatgttggccaggctggtcctgacctcaggtgacccaccctccttggcctcccaaagtgctgggatgacaggcatgagccgccccagccagtcaaaacctacactttatacagtcacaccaccggtcacttttacaatatgtaaagtaattatttagtcacagttgcatagctaccagtgcccaaccgtaggggatgcacccagttaaacacagacaaacgcaaggacatggcatcacaggtcctgagaatcaagacacacacatttctcaacagatacacaatcagaatgggtgcaccacaaatgcactacacaaaaagacaaaacaggcggggcgcggtggctcacgcctgtaatcccagcactttgggaggccgaggtgggtggatcacttgaggtcaggagtttgaggccagcctggccaacatggtgaaacccgtctctattaaatataagaaaaaaggccaggcatggtggctcacacctgtaatcccagctactcaggaggctgaggcaggagaattgcttgaatccagtaggcagaggttgcagtgagccaagattgcgctactgcactccagcctgggcaacagagtgagaatccgtctcaaaaaaaaaaaaaaaaaaaaaaaattagccaggcatgatggcatgcttcagtggtcccagctacttggaggctgaggtgggaggatcgcccaggaggtggaagctgcagtgagctatgatcgcgccactgcactccagcctgagcgacagaacgagaccctgtctaaaaagaaaaaacaaaaacaaaacaaaacaaccacatagactcacagaatcacacaagttcacacacacacacacatacacagacacagacacacacacacacacacacacacacacacagagtcacaagtatctacatgtgcttcctgggacagactggcagaaaggtttgctaagatcgcccacttggagctcgtcttccccacaaccagcacccaattagagaactcgagtctggcctcctgggttcaggaggacgcctagtgctcgcgccagaatttctttgtttaattcttgactccctccgcacacaccccctgcaactgaccaaccaggagtgggccgagccctttcctacggccaataagaggagaaacccagctggccaatcggtttcccgcactcgtcttccgcccctaccccgtccgcttcttaaaggggctagcctatctctgtctgggccccccgatttccacaggcaaggctaccttagcccttttaaaaggcagagctgcggagggggccggattctaggaggaaccaatgaaaagcctcactcggcctccgctcctcccacttcttgctgaggtcaaaggcctgcgtcagttgcactgtagcctcggcagtgaaccgggaggtactaccaggtaaggaaggtgcggtagccccagccgtgggtgagaggagctccgctctgacacccccgctcctgtaggtcgccgtcgttgctccgctcgctctgagagagcatggccctgagaggcgtctccgtgcggctgctgagccgcggacccggcctgcacgtccttcgcacgtgggtctcgtcggcggcgcagaccggtcagtgtggggtcgggagtgtggagggaaggagggaggaactgggggtttagggactttccggggtgactttcccgttctgtgcttgcagagaaaggcgggagaacacagagccaactggctaagtgtaaggacctctggtcgcaccgtgtgtctgctgcccctgttcagctgtctgtctgccgcaggtggactctgtcccagaatccgagagctgcccgagcggggtggcagggtcgtggccagggtcagaggcactaaggcagtgagtgcgctgtgcctgcggggccggagaaaagtcacctgatcagtctcgcttgcagctcgcactagccggggggcgacatgggtgttggggggtagggctgatgagggtccgagaagggagggcacagtgatcttgcggactggaccgaggcgaattccccttcccagcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggtgggcgggctggtgggtgccctgagactgctcctccgcctggagccatagccaccccacctcaaggcccctctgtccttggggctggggcttcctgtggcctaggcctgggcctgaatttgggcactggtccctttgcagtttttcatcgggagatcatttcggagatgggggagttgggtgtgctgggccccaccatcaaaggtaggaacaagtatctctccacacactgcagaaccctctgtattctgaaagcctcttcctccttccctccctccctttcttccttccttctctttcttttcttttccttttctttcctttcttcttcccccccaacagagtctggctctgttgcccaggctggagtgcagtggcacgatcttggctcactgcaaattctgcctcccaggctcaagcgattctcctgcctccacccctctagtagctgggattacaggtatgtgccaccatgcctggctaatttttgtatttttagtagagacagggtttcactgtgttggccaggctggtctcaaactcctgacctcaggtgatccgcccacctcagcctcctaaagtgctgggattacaggcatgagccaccacgttcagccttctttttgagatggagtttcgctcttgttgtccaggctggagtgcagtgatgcaatcttggctcactgcagcctccacctcccgggtttaagtgattatcctgcctcaggctcccgagtagctgggattacaggcgtccgccaccacgcctggctaatttttgtatttttagtagaggtggggtttcaccgtgttggccaggctagtctcgaactcctgacctcaggtgatccacccgcctcagcctcctgattacaggtgtgagccaccgttgcccggcccttttcttttttttttttttttgagatggagtttcgctctgtcacccagcctggattactggattacagtggtgcgatcctggctcactgcagtttcctcctcctaggttcaagcaattctgccacctcagccttctgagtagctgggattacaggggtgcaccaccacgcccagctaatttttgtattttttagtagaaatgggatttcaccatgttggccaggctggtcttgaactcctgacctcaggtgatccacccacctcggcctcccaaagtgctgggattataaacgtgagccaccgtgcctggcccctttgtttctttttttagagacagggtctcactgtgttgcccaggctgttctcaagtgatcctcttgccttactgaaagcccccttctttccctaagccacaatttcccagtctgtaaagtggggctgttgtcccaccctctgaaagtggctgtggagatgaaatgaataaacctcagctagggccagcttggtgcctgcctccttgtgtgtccttattcagccctgtctcttgggtcttagctgggcagggccctgttctctattgtcctgctttcccctcctactaccaccaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctgggtgagtggctgcccatggggcctggtggaaggaagacagtctctgaggtctggaactcaagggtggggctgtcccctgagcctattctgtccctatctcaaagatagcataagtggccacctggacccccgccagaccctgggcttcacctggagatctgatccctggccagcctgactgtccccctctgtgaccaccgtcatctccctatgctttctgtgttccccagtccagcccaaagtttaaagtccaccaggttcctgctggccatttgcagtggctcacacctataatcccagcactttgggagggtgaagtgagaagatcccttgagcccaagagttcgaaaccagcctgggcaacgtaaggagaccccatgtctattagaaaaacaaaaaaaggaaagagcctatgtgacctgcgctaagtggacgttggccctcttccgtggtgtctcggaggtgttcagctgcttcaagatgaagctgaacatctccttcccagccactggctgccagaaactcattgaagtggacgatgaacgcaaactttgtactttttatgagaagcgtatggccacagaagttgctgttgacgctctgggtgaagaatggaagggttacgtggtcggaatcagtggtgggaacaataaacaaggtttccccttgaaacagggtgtcttgacccatggccgtgtccacttgctactgagtaaggggcattcctattacagaccaaggagaactggagaaagaaagagaagatcagttcatggttgcatcgtggatgccaatctgagtgttctcaacttggttattgtaaaaaaaaggagagaagggtattcctggactgactgagactatgatgcctcgtcacctggggcccagtacagctagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagcaccagggacaaatcgtgaagagacgcagactgtcctctctgcgagcttccacttctaagtctgaatccagtcagaaataagattttttgagtaacaaataagatcagattcgcaaaaaaaaaaaaaaacccacaaggccctgtgtgaccaggcctctgctgacctttccacctcatctctggccactcatgtgatcctcccagccagacttagctacttgaaattctccagaagtaccaccagttctttacacatctgttccctctcccagcactgctcttccccacagcctcctcctgcttaactcctcacacccttccagtttggccaactccttcctgattccctgggtccccctccccatcttggcattgtgatcatgactttggggtaacctgtctcttgaaagcagggccagatctaacttagttatgaggtctgactcaggggcgagggtaattttttttttctttttttgagacaaagtcccgctccgtcccccaggctgaagtgcagtggtacaatcttggctcactgcaacctgcggttccccagttcaagcaattcctgtgcctcggcctcccaattagctgggattgcaggtgcttgctacccgtgcctggctaatttttgtatttttagtagagatggtgtttcactatgttggccaggctggtctcgaactccagacctcaagtgatccatctgccttggcctcccaaagtgctgagattacatgtgtgagccacctcgactggcctaattttttgtatttttagtagagatggggtttcaccatattggtcaggctggattttttttcttttttgagatggagtcttgctctgttgcccaggctgtagtgcagtggcatgatcttggctcactgcaacctctcctgcccgggttcaagcgattctcctgcctcagtctcctgagtagctgggattacaggcacccaccaccacatctggctatttttttttttttttttttttaagtagagatggggtttcaccatgttggccaggctggtctggaactcctgacctcaattgatccacctgccttggcctcctaaagtgctgggatgacaggcgtgagccactgcaccccgccacgaggataatttttgagtaaggggatgtatcagggaccaggcagccttgtgactttgtcttgtgcctgcagccaagggggagctcctgggctgcttcgggctcacagagcccaacagcggaagtgaccccagcagcatggagaccagagcccactacaactcatccaacaagagctacaccctcaatgggaccaagacctggtaagggttctgggtggtgggcaggtggtgaacaggggcaaaggggcactggtcagacccctcaccgactgttccatccccaggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctgggggtaagtggcagccactttgggaatgggtgttgggtcacctgcggatgcggctttgtcaggcaggctccgtgctggggacgcggctccctgtgcctgtggagcccacacagtggtgattcttactcagccggactcgctgacgtgctgaaaactgcccccatttggtgaccgtctcgctcatcccggctctgcccgggacacatgggcctgaaccagctcagtcatttgactcacagtgcatcttctggcatccgtcagcctcctggctctgagcatcgaacccagatgccaggctgggtgggactgtgtgcaaaccgagtgagcaggcaccgagcttcagtgccagggccatctgtgatgtgaaccacaacctgagtccccctgcgtggggtggctggggaggaggctttccctgcttcagagttggttctgcataggccctcttggtgtctcttgggtgggcctgaggcgccatctcaaccctacagggtcccttcggctgcctgaacaacgcccggtacggcatcgcgtggggcgtgcttggagcttcggagttctgcttgcacacagcccggcagtacgccctcgacaggtgtgtgagggctgcagtgagattctctgggggtgtggggcagcttgggtttcactctctataccatgggtgactccccagcccccacccaccaggcctgagttccttgctctggaatgaccagtgacgtccttctgagcagctgtgggctgagtcaacggcagggccagggcaagcttgggggcactgaggcagcctgggaaggcgtcctggagcagggggccccaggacagggacggggtgggagagtgggcctcccctcgctcttaccctgccattgcccatgtaggatgcagtttggtgtcccactggccaggaaccagctgattcagaagaagctggcagacatgctcactgagattaccctgggccttcacgcctgcctgcagctcggccgcttgaaggaccaggacaagtaggggctgtgtggtgggggcggggggatggcagcggtggctggaggaccttgtgtccttcctggagagaaaggtccttcctgcctggtggccctggggacctgaaccttctgctgtccctcttgtccttgatgggctgggctgaggacagccccactggtccctcattgggagcttggctgcatcagggaatccccaccccgggctaggtttgcttggagcatcgggatgccaggatccccagtccttgttaccctcatgtgccactcccagggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtaggagctggacctcagagggctcactgaggcctcagtgtctggggagggggtacagggaggtgggacggggacaggtctgagtccaactccacctatcactaagtgacagtgtgacctggggcgagccttacccctctgtccctcatctggagttactcacatggggactgtggaagtgaagtgcttcatgcagcacacagaggccccatcaggccttgcgaggggctcccagctctttctcccacatgctcgggaggagggatgttcctgagacaggtaagctccgaaggcagcccaggggtgaggcccgactcctagcaggctggtggacgcaagggagtgagcgaagctacacgcaggaatcaacgctccattttgttaagagacaaaagtcatcttcagatgacggtgtttgcaccctgtaactgatggtgatttacatgggggtccagaaccccttgcttggtgggaagacagatgtggaaaaagatacttaaaaaaaaaaaaaaagtgcaaacccagcatgcgctatgtagaaatagagggaggtatgaggaccccccgggcagagatgcttccagacagagagaacagcaaatgcaggaggggtgccttccctgcgcaccttgcaaccccagatcttgtctctatctggcatctggggggtggggggatcctacaaatgtgagaatgaccctgaggacaagcagcgggcgccatgagatggttttatgcagagaagggatgagtcagatttggtgctttaggggctcggcgcagtggctcacacctgtaatcccagcgctttgggaggctaaggcaggaggattgcttgagcccaggagttagaagttatgatgagctatgatcaccccactgcactccagcctgggtgacagagtgagaccctatctatatttaaaaaaaataggtttgtactttaggaagtaaacagaattggctctaaaaaggaggctacaatctgccttctgcttcaaggagctggggaggagcaaaggatgagacaccagggcatggggtgtgggattctctgggagaggcggcttcagatgggcagaggtcagctgaggcaagtgactgctcttccgatgtgctgtccctcctatccctcccgagggtaagaaagggcttgctgtgtttccttggagctcaggggtgctttcagcctctgtggcaaggaagcgtggccaggttgaaaatcaaacatttaataaactgtggggctgggggtggggagaacttgccaagggtggggagcacgaagcctgggcctatggcaggggctggacttgctacattttgggagttcagcacaaggagctttgggtttttgtttttttctgccaagatgcattatagaaccatgaaaaacaatttctcagtgtggcccaaatggtggcctcacagtcttctcctggagactgtcactaaggcgtgagtctcccggcagctgtcagcattcaccatctctgttggtctgtacttctgaagcagtggcctggggatacatgaaaattgattttaaagggaagttgtgagctatgaaaactccaaaccgactctgtattaatcttgtccaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggtaaccacctgagaagtagtttcagccacagaagaaacgaacacgtctgggggctgtgagttgccgggacgtggtggggactttcccctagagtggtctggcccccatctgagtcttaggctctgctgtaaaaaagaaacccaggttagcagtgccggtctgtgccagggctgtgggcagaggggatgatttctgagtggcaggggtgcaagggactttgtcctttctgtcaccacagagctgctcatacaacagtgggacatgacaacggtttggcttctcagctcagacacaccatgttataggggatcacaaacaagatggtgagtgcaccaagggctttgcagggactgtggcctggcggggtcagggctgggtgcctggtttctgttcacatttactcttggctgggccatccctgtcctcttcctcaggcagcgccccccctgtgagtttactcatacctcaggctggagacacaggtctttgtacacagtctccacgctgtggcagacttgtttgagctctgtctccaaatggctgatctttgccattttctgggtgaactcttggagcttttcctggatgatcttgttgtggtcattataaatctgatagatcctctcctctaatttctctgtcagatccgaaacctgttaaacaataagatgtgttctcggaaaatcaaacaagaggtatcacaagacatctgtgttaagtgggtttcttagatttctgcaatttatcttatgaaaatgacaaaataggctgggcacggtggctcatgcctgtaaccccagcactttggtaggccaaggtgggtggattacttgaggccaggagttcaagaccaacctggccaacatggtgaaaacccatctctattaaaaatataaaagctaggacgggtgtggtggctcacgcctgtaatcctaacactttgggaggccgaggcgggcggatcacgaggtcaggagatcgagaccactgtgaaaccccgtctctactaaaaatacaaaaaaatttagccgggcgaggtggcgggcgcctgtagtcccagctacttgggaggctgaggcaggagaatggcgtgaacccgggcggcggagcttgcagtgagctgagatcgcgccactgcactccagcctgggctacagagcaagactccatctcaaaataaataaataaataaataaataaataaataaataaatacacaaatacataaaaactaactgggcatggtggtgtgcacctgtaatcccagctactcgggaggctgagacaggagaattgcttgaacctgggaggtggaggttgcagtgaaccaagatgatgccattgcactctaacctgggcaacaagagcaaaactccgtctcaaaaaaaaaaaaattagcaaggcataggtgacgcgcacttgcagtcccagctactcggaaggctgaggcaggaggatcacttgagcccaggagttggaggctacagtgagtcatgatcacactactgcactccagcctgagagaccctacctcaaaagaagaaaagaaaaacaccaaaaactaaaacccagtgcagtgactgggggtcagattgcctatattttaaatttttttgctttttttgttttgttttcttgcggcggagtttcgctctcattgcccaagctggagttcaatggcatgatcttggctcactgcaacctccgcctcctgggttcaagcgattctcctgcctcagcctcccgagtagctgggattacaggcgagcgccaccacacccagctaactttttgtatttttagtagaaacggggtttcaccatgttagccaggctggtctccaactcctgacctcaggagatccccaccttcagcctcccaaagtgctgggattacaggcatgagccactgcacctggcctgttaaatttttttaagaggcaaaagtatatacagtcgtgtgctgcataatgacattttggtcaatgtcagactgtatatacaatgatggcccataagagtataatgccatatttttactgtaccttttctatgtttatatatatttagatacacaaatacttaccatcatgttataagtgcctacagtattcagtatggtaacatgctgtgtgcaggtttgtagcttaggagcaataggctcttccacgtagcctaggtgtgtagtagactataccatctaggtttgtgtaaattcaatctatgatgttcagatgatgacagtgtcacctagggatgcatgtcacaaaactgtacagtacaagctcagccaggttaggaagaaagtacacagaatagaagaggcatccaacaaagtggcctctgggtgctgtatcaaaataaataaataaataaataaatgtttttgtatcttttctactagaggccaaggcagcagggtgaggagttcaagaccagcctgggtaacatagcaagatcccatctctacaaaaaaaatgtttaaagaaaattagctgggcatggtggtgcacacctgtagtctcagctacttaagaggcagaggtgggaggatcatttgagcccaggagtttgaggctccagtgagctgtgatcgtgccactgctctgtaagcctgggcaacagagtgagacgccacctctaaaaatataaataaataaataaaacaagtgagccgggcatgatgttgcatgcctatagtctcaagctactcgagaggctgaggtgagaagattgcttgagcccaggagttcaagattgcagtgacctatgattccaccactgcactgcagtctgggcaacagcaaggcttgtctcaaaaaaaaagaaaaaggaaaataaagtcaatctgtcatcaagacacctagaaccagcaagctgtcccactcatgtgacccattatgtattttgtttgtttgtttgtttgctggaattataggcacgtgctaccatgcctggctaatttttttttttttttcgagacagccaagatcgtgccactctactccagcctgggctgggcaacagagcgagactctgtctcaaaaaaaaaaaaaaaagaaaaagaaaaaaccagaaagaggcagtcttctttttcttctttttttttttttttgagatgaagtcttgctctgtcacccaggctggaatgcagtggcgggatctctgctcactgcaagctccgcctcccgggttcaggccattctcctgcctcagcctcctgagtagctgggactacaggcgcccgccaccacgcccagctaattttttgtatttttagtagagacagggtttcatcatgttaaccaggatggtcttgatctcctgacctcgtgatctgcccgcctcggcctcccaaagtgctgggattacaggcctgagccaccacgcccggccctcttctttttttttttttgagacggagtctcacctgtcaccaggctggagtgcagtggtgcaatctcggctcactgcaacctccgcctcccaggttcaagcaattctgtctcatcctcccgagtagctgggactacaggcgcgcaccaccatgcccagctaatttttgtatttttcatagagacggggtttcaccatgttggccaggatggtctccatctcctgaccttgtgatccccctgcctcagcctcccaaagtgctgggattataggcgtgagccaccacacctggcccctatttatttatttttgagacgaaatcttgctctctagcccaggctgcagtgccgtgcagagccactgcactgagccaatttttttatttttagtagagacgtggtttcaccatgttggccaggctggtctcgaactcctggcctcaagtgatccacctgcctcggccttccaaagtgctgggattacaggcgtgagccactgtgcctggtccccccattatatattctgaagaggcatcaggtgcaaccattcatgtaggacctgaacatcacaccagcttttgcaagatgtaagccctgggcatgtggaagaagctccactcccccgtcacagaccattcgatggcttctgcaggacatatgggtgtgacaatgcaagttgtgcctcaaccccctactcccgtggctgctcgaccttgcgtgaagtaagagggctgcgtgttggaggcaggagggcatccaacgccccgctccctcagcctggctctctcgtcaggcaaatcattcatttccaagccttatctatatcatgggtccaatctcttctctgtaggactattctaagggtaaattgagatacagatggtcccaacttactacagttcaacttactacatttttgacttacagcattttcaactcacaatgggtttattgggacgtagccccatcataagtggaggagctcctgtgctgtgtgtgaatggcctagcaccgtgcctggtgtacaacagacaccatcagtggttcattccctccccttttgcataaggaatcccccctctcgctgggtggagtctgtcaccttggtcttcaggctgttcctgaagttggtcatgagtgcatggtccttttgccggctcttgttgatgttttcgatcagctcctgggctctcttctgcaggatgtcaatgcttgagtccagagaggagaagtagagtcccgacttcccttccaggaccgtcagctggcaactggcactggaggtggcgacacaagggcaagaaacctgacttctcagagtacaggaagcggccaggtgtagtcgctcatgcctgtaatctcagcactttgtaggccgaggtgggcggatcacaaggtcaggagttcgagaccagcctggcaacatggtgaaacctcgtctctagtaaaaacaaaaaaacaaaaaattagccaggcacggtggcacgtgcctgtagtcccagctacttgggaggctgaggcaggagaattgcttgaacccaggggatgaagttgcagtgagccgagatcacgccactgtactccagcctgggtgacagagcgagactccgtctaaaaaaaaaaaaaggacaggatgctgagatcagcaccagactcttccaagagcggctgatctgagagagatcaggtgggaggggacccgcgttgttgccttccatgggtgacacgaggcatgcttcctaggttattccattcacacacacgccctgaatgatgagaatggcacccccattttatagctgagaaaacagaccaagaggcacgactaaatatgcccaaggttccagaccaaggaggtctgtctgtccccaaagcccactgttattttatgacaccaacttgcttctttggaattttggaataccaataatagtgtcaatgctttctttcttttttttttgagacggagtctcactctgtcgcccaggctggagtgcagtggcgcgatctcggctcactgcaagctccacctcccgggttcatgccattctcctggctcagcctcctgagtagctgggactacaggcgcccgccaccacgtccagctaattttttgtatttttagtagagacggggtttcaccgtgttagccaggatggtctccatctcctgacctcgtgatccgcccgcctcagcctcccaaactgctgggattacaggcgtgagccaccgcgcccagcccaatgctttctttcttattttctttttttttatagagacaggtctttctctgttgcccaggctggagtgcagtggcacaatcatagctcactgcagtgtcagcttcaagtgatcctcccacctcagcctcctgaataggtgggactacaagcatgtgctaccatgcacagctaatttttaaaatttttaaatagagactgggcttcactatgttattcaggctgctctcaaacttctggcctcccaaaatgttgggattacaggcatgagccactgcgcctgactgatgcaatcagcaatctcctgcaacctctgtctcctaggttcaagccattcttctgcctcagcctcccgagtagctggaattacaggtgcacaccactacacccaggtaatttttgtgtttttagtagagacagggtttcaccatattggccaggctggtctcgaactcctgacaagtgatcctcctgcctcggcctccaaaagtgctgggattacaggcgtgagccactgcgcccagcctgatgctttcttaagtgaccttcctgtcattaacctgctgcatccctttcccaacctactgggtgatgttgaccgcctggggctacagtgtacctgcacctccttgctcccaccaggtgaggtgaatacctgttgaattatatttaaagagcatttaaagaaatgcgcacacacaaaaagttgttggtcccatgttgtacatgtaactgtaattatgtaattcaaatattgtgttaacaagtgaaatagtggcagaagagtgacagctatctaaaaagctaaacagaatgaaaaattttgagtaatatgtaatgttccgtaacttcataatattcaatgtaataaaatggaacttcagttgggtatgggagagagaactaaaattgaagcaaagatcataaaaatctagaaaaattctgcatatagattgctctgccaaggccttgttctctgctttaaaaacagaactggggccgggcgcggtggctcaagcctgtaatcccagtactttgggaggccgaggtgggtggatcacaagggcaggagttcgagaccagcctggccaacatggtgaaaccccatctctactaaaaacacaaaaaattagccaggcgcagtggcaggcgcctgtaatcccagctactcaggaggctgaggtacaagaatcgcttgaactcgggagccgagatcacaccactgcactctagcccgggcaacagagtaagacttcgtctcaaaaataaataaattaattaaattaaattaaaataaattaaaacaactgaaaattgtgggtaatgcattgtgaatgaagtttatggaaaaaatgtgatctgataaggcaacccattggtattttaaattaagatatattttttcttcttctgatgctctggtttatttgaccggtttgacgtctgatcagttagcggttctggccaggtagagctgcccctgtgagtcacagctaacttttcctcagccatgttcccggcactgagctaagtcacatgccttgtcttggtgcatcctcacgaccacactcgggtcatctgctgttctctttacgacatgggcttagagtggttacaccaccttctcaaggtggaggacagtctgtggcagagctgggctttgtacccagaaggcctgacttcccagctggtatcctgcttcctactaaggcactcaggcgccactcccctcctggatcttacatttcctcgtcgccctctgaggtcctccagctctgaaaggccaagccttgtaggtgtggacagagcagttcctgaatgcagcaggtcacacttgtgtccacaagcaggttactgattacttacaaaaataaatcttggccaggcacagtggctcacgcctgtaatcccagcattttgggaggccgaggcgggtagatcaccagagatcaggagttcgagatcagcctggccaacatggtgaaaccccgtctctactaaaaatacaaaaattacccaggcatggtggcatgtgtctgtaatcccagctactaggcggactgaggcaggaggatcgcttgaacctgggaggcagaggttgcagtgagctgagatcgtgccactgcactccagcctgggcaacagagcgagactccatctcaaaaatataaaataaaataaaaataaatctcagctatctcaaccaggcacagtgggctcacgcctgtaataccagcacttcggggggctaaggcaggtgaatcgtgagctcagggttttgagaccagcctgggcaacatggcaaaaccccatctctacaaaaaacacaaaaattagccgagtgtggtggtgtgtacttgtagtcccagctacttaggaggctgaggtgagaggatcacttgagcccgggaggtcaaggctgcagtaagcttgatcatgccactgcactggagcctagatgatatcacgccactgtactccagcctgggcgacagagtgagaccctgtttcaaacaaacaaacaaaacaaccacaacacacatatacacccctcccctctccacccggtctcccccagccggccacctccctctttcctccccatcaaggccaaggttctagaaggagctgcttaaattttctgggcttttttttttttttttttttaagagagagagagagtctcaccctgggcttcttttcttttcttttgagacagagtctcgctctgtcaccgaggctggagtgcactggcatgatctcagctcactgcaagctctgcctcccgggttcacgccattctctttcctcagcctcccgagtagctgggactacaggcgcccgccaccacgcccggctaattttttgtatttttagtagagacagggtttcaccgtgttagccaggatggtttccatctcgtgacctcatgatctgcccacctcagcctctcaaagtgctgggattacaggcgtgagccaccgcgcccggccatcctgggcttattttcttacccccattcacttttcagtccattgtaatcaggttcctcccccggttctcaaatgaaacagctcctaccacagtcaccatgaccttgtggttagaccgatagacatctcagagtgacatgctgacctcttggcagcagccagcactgctgaccacccttccctgctactcccgacatgtggtatcccagaggtctgtgcttgggcctctgctgtcttcttgccagacaccgtcaatcacacacttgttctgcagtgaggcctccatgcctcctccctgctggcccctgcagctaatatcccagccaccattccacaatgcacaggctattattctccaaaggcattcattcccgtagcatgggatccctgaacagtcccctttcccacctacgtcctgtctcctccagaaagtgttccttggctggattaggtgcacacagcacctacggtttcactgtttacaccttggcctcccactgtagtctgctgaagggccagggccatccttcatctttgtatcttcagtacttacccctcatgagagaagcaataaatgtgctgctaataagtaaatgacttgcgagtactatccattaccatccacactttggattctatcatctaaattctatcatcccagcccatgcctctctcctgaggacccaagaatatatgaaacctcccagcctccccacatggctgtctcaaaggcatctgaaactccacatttgcacaaccaaaagcgtcatctcccaggcaacccgatttcatcttccattcccttagttaatgacataaaaagccacctggttcccaagctcaaaacttagcagcaagcctagagtccagcttctctctgtccctctgcatcctgtctcaaaatcccctcatttctaccttctttgtttttttatttttatttttaattaatttttttttcagatggagtttcactcttattgcccaggctggagtgcaatggcgcgatctcggctcactgcaacctccgcctcccgggttcaagcgattctcttgcctcagcctcccgaatagctgggattacaggcatgtaccaccacactcggcgaattttgtatttttagtagagacggagtttctccatgttggtcaggctggtctcaaactcccgacctcaggtgatccgccctcctcggcctctcaaagtgctgggattacaggcatgaaccactgtgcccagcctttttatttatttgtttttgagacagagtcttgctttgttgcccaagctagagtgcagtggagcgatctcaggtcactgcaacctccaactcccggtttcaagcgattctcttgcctcggcctcccaagtagctgggattacaggcacctgccaccacacccagctaatttttgtatttttagtagagacggggtttcaacatcttggccaggctggtctccaactcctgacctcgtgatctacctgcctcagcctcccaaagtgctgggattacaggcgtgagccaccatgcccggccctaccttcttaatgtctctaaatctaccatcattagcagctctataactttcacttctcaactaggccatagggacctttattttatttacttatttatttttgtaaaaaattttgtaataaattttatgttaaaaaatttttttttcttttgtaagaaattttcttttgtaaaaaattttgttattattattttgtttttgagacagactctcactcggtcgctcaggctggagtgacaggctggagtgtcgctcaggctggagtggtgcaatctcagctcactgccacctccacctcctgggctcgagtcattctcgtgccccagcctcctgagtagctgggactacaggcacacaccaccacgcccggctaatttttatatttttagtagagacagggtctcaccatgttggccaggctggtctcaaactcctgacctcaagtgatccgcctgcttcggcctcccaaagtgctgggattataggcatgagccaccacgcctgaccttttatatatatatattttttttgagatggagtctcgctctgtcccccaggctggagtgcagtggcacaatctcggctcactgcaagctctgcctcccgggttcatgccattctcctgcctcagcctcccgagtagctgggactacaggcgcccgccaccacacctggctaattttttgtatttttagtagaggcggggtttcaccatgttagccaggatggtctcaatctgctgacctcatgatccgcccgtctcggcctcccaaagtgctgggattacaggcgtgagccaccgcacccggcctgacctttttttttcttttgaaggcagggtttgctacattgccaagctggagtacatcagtacaattactgcaactttgaactcccccaggctcaagtgatcctctcgtctctgcctcctgaatatctaggactacaggcgggtaccactactcctggctaaattttgtttaatttttctgtatagatggaggtcttgctatgttacccaagctggtctcaaactcctggcctcaaaaaatcctgcctcggcccccaaagtgctgagattacaaacgtgagccacagtgtcagcccctagtgacattctacactgtaatctgatttcctactcctgtttgttagcctaaaaccatccccaccagccacaagatcaagtctaaattccttcacacagcatacaaggccttccagggccctggcctccaccctctcttccagccttaatgggtttttttctttttctttcttttttcttttttgagaaggggtctcactctgtcgcccaggctggagtgcagtggcatgatcttggctcactgcagcctccacctcctgggttcaagcaattctcccacctcagcctcccctgtagctgggattacaggtgcctaccaaccatgcctggataatttttgccttttttttttttttttttttttttagacgaggtctcgctcagctgcccaggatggagtgcagtgccacgatctcggctcactgcaaccactatctcccaggttcaagtgattttcccatctcagcctcctgagtagctgggattacaggcacctgccatcatgcccagctaatttttgtatttttagtagagatagggtttcaccatgttggccaggctggtcttgaactcctgaccttaggtgatccacctgccttggcctcccaaattgctgggattacaggcgtgagccaccgtgcccagtgcagccttactgttttctttttgtttgtttgtttttttcaagacagagtcttgctctgtcacctaggctggagtgcagtggcacgatctcggctcactgcaacctctgcctcccgggttcaagcaattatcctgcctcagcttcccaagtagctaggattacaggtgcccaccactgcacccagctaacttttgtatttttagtagagacagggtttcaccatgttagccaggctggtctcgaactcctgacctcgtgatctgcccgccttggcctcccaaagtgctgggattacaggcgtgagccaccaagcccgatctagccttactgttttctacagcccctccatctgcagcaattggggacctaccacaatttccccaaacatgtcagcctttgcctggaatgactttcccttcctgcctccttcataatggaacatttggaacttttgcttctctaccccccgctatacctaggccttgctggtcacaaagctgccaaagtttatgaacatcagtcccctccagcgcacgacaccttgagggtgcagactacaccctactcatttgttttgcagcaccccaaaggtttcatcagtttgctgaatatctaaatgaatgcagcactgacattggggctcccacacctcctcgtacccagttcaccttgttgtctcagcctctcctggatgctctcaacagtttcagaccctaaaattaaaatcgatgagagcaccaggtgtttctttttgtgtgattgttcacaacctgcttgagctgctaatggttcagagctgctcctttttaaggctcaagggatgaggctggaaccggttttcatggcagctaagcaaacagtaaaaaaaaaaaaaaatcacttgaattcagctaattcgagtttcatggtaggacaaaggcctgcatcagatgtctgctgagagcttctttatttttccaacctctcctttggggatttatcccttttgatttcatttttcttaatacacagcagctgcatattaatcaggatgctaatgaatcataggcttccctgggcctgcattcaccaattaactttaacaaacaaaatgcgtggtgtcctctctgctggctttcccggttcctaggctggcttctgttgccgaaccctggaccgaggccagagaatgcaagtcagcccaacacagcacgtcgggtgtgcatggcctgcgcccggattgggcagcgggctgggggctgtgaacacagcgctgcgttcatctattatggtctgtccttctaagaagtccctaatttggctgcgaggattaggacatagttcccaagcagggcccacgctggcagggggcccaggagctgcggaggaaatgggtctaagcgaagagaccatctgttcgctccaggtaaagctgtgattggcaggcgactgagccagaactgcccgctggtggggccctccctccgtggcctctaacagatatacaagtaaacaatccgccagccacttatgaccaccgcgggtggcagtcccgggagaggaggcaagctaatcaaacattcaaggggggaacacaacagaatctctggcgcttgggcaaaacaatgttttgctgaagtacagccaggaagggggaaggtttgaatggaagctgatgagccagttcctcaacctctccttttctctctggaaacgtgttaacattttaatcatgttgctgagtatctgctgctggatctattaactggcccctgcactggttttaatctatctgttttttggcccagggttcctgtggagctccttgaagtctctaaatgatttgcagcggtctgtgtctcttcactacacagatcctggtctaaacatgctattccgcagtaaggtattagcaaacaaacgacttcaaccattgcttccctttttttttggtctccaattgacagcacacacctataaaccatttcacgcgtggcctgctttccagcagaggaatgtgcgaggagagggaagctggcttgctttctgcctagagtcctcagggccctgtcctgaccctcctctcactccttctccaggtgagctcattcattccacagctgctgctgaaacaatgactcccacagaaccatctccagaccctcaccccaccccgagttccgggtcagaaagttgaactgtatcctggacatgtggatgtccctggccaccgaaagtggctcagataaacaaggacaacacagaactcatgttcttgtctctgccagagaagccaccacctaccggaaaccaccacaagctggaaagcagacagcagtgatgtgcttgtaagcatttagcaactggctgtgtgatgggggggaagccctgattcgtagtgtttgccaatttccgtggtgcagagcctcccaccattagccaatttcaggctaccaacatgaagacgctaaatgccaagttgggaagagatgtgtagaattggctctttcaagccggtaggagctggccccagtacatcatggccgggaaacatcctccctcatccccttcctgtgtcttatggcacaaggcacttcctccatctgccctgctaaaggccaccccccccacaccccccataaaagcctcccactagacctccctacacccacacattctccctcccaaccattctctacaaagcagccatatttttttattaatattttttgagacagggttttgttcttgttgcctaggctggagtgcaatggtgcaatcttggctcagtgcaacctctgcctcccaggttcaagcgattctcctgcctaaccctcccaagtagctgggattacaggcatgcaccaccacccctggctaattttgtatttttagtagagacggggttttgccatgttggccaggctggtcttgaactcctgacctcaggtgatccatctacctcgaactcccaaagtgctgggattacaggcatgagccatcgtgcccggcctgcagccgtatctttttataacgggaacctgagcatgtcacttctgtgacccagcagttcccctcctaggtatgagtatgcccagaagaaatgaaatcatctgtccacacacaaacttttctaaatggatttcatagcagtgctgctcataatagccaaaaagtgaaaaccacccgaatgactatcaacagatgagtggataaacaaaatgtggtagactcatgtggaatattattcagccattgaaaagatgaagtccagatgcagtggctcacgcctgtaatcccagcattttgggaggccactgtatctggcctggagtgatgaagctgttttaaagttgactatgagaatggttgtccagctctgaatataccaaaagcaatcaaatcatacccttcaaggaggtgagccgggcgcggtggctcacgcctataatctcagcactttgggaggccgaggcgggcggatcatgaggtcaggagattgagaccatcctggctaacacggtgaaaccccgtctctaccaaaaatatataaaaaaaagccaggcctggtggcacatgcttgtagtcccagctactcgggaggctaaggcaggagaattgcttgaatctgggagggggaggttgcagtgagccaagatcatgccccctcactccagcctgggcaacagagcgagactccatctcaaaaaaaaaaaaaaaaaaaggtgaaccgtatgctatgggaattatatctcaaagctgttactgaaaaaacctctaggataaagtctgtagcccacaaaatgcctcataacctggccccttctgcagccctccccttgcactcacccctgtaccccactcgctcgcctagccacactggccttcctttagctcccccgaatgccacgagcagggacttcgcacgagctcttctctcaacccctccttccccaccctgcccacactttctgcttcaacatctcttctacaaggacaccttccctggctccccattccaggctggctgcccacaggggaaaggtctcccagcaccatgatctcttccctgttggtgtttggtcagatgcaaacagcaggagggtatgagcatgtctgtctggaggacaggagtgtccctgctgccaatcacaatactgccatatcagcctttttttttttttttttcctcgagacagggtctcactctgtcacccaggatggagtgcaatggtgctatcttggctcactgcaacctctgcctcccaggttcaagcaattctcctgcctcaggctccggagtagctgggattaaaggcatgcgccaccacgcctggctaattttttgtatttttagtagaaacagggtttcactatgttggccaggctggtctcgaactcctgacctcgtgatccgcctgcctcggcctcccaaagtcctaggattacaggttgagccactgcgcccggccaacatgagcctccttcttgctcttttgagaacacatcaagcttattcctacctgagggacttcatacttgcggccccctctgcgtggaaggtttgggcccagaatgcctcctggctggcctcttctcatgtgacctcttcagagttctccaactgctctaaggtccctgtcactctacttgctccttactatattttgtttcttcattccacttacttgccaccagttgaaatcacattattcacttatttatttttgagacagggtcttgctcttccagtgcagtgaagcaatcacgtctcactgcagcctcgacctcccaggctcaagtggtcctcccacctcagccttccaagtagctagggccacaggtgtgtgcaaccgcaccacaccacgctcatttctttctttctttctttcttttttttcagagagatatgtctccctctgttgcccaggctggtctcaaactcctgggctcaagggatcctcctgccttggcctcctgaatagccaggactacatgcatgcaccaccacgcctggctgatttttgtgtttttagtagagacggagtttcaccatgtgggccaggctggtctcgaaatcctgacctcaagttatctgccagcgccagcctcccaaagtgctgggattacaggcgtgagccactgcgcccagcctctactatatatatactttttttttttttttttgagacagagtcttgctctgtcaccaaggctggaatgcaatggcacaatcttggcttactgcaatctctgcctcccaggttaaagcaattctcctgcctcagcctcctgagtagctgggattacaagtgtctgtcaccatgcctggctaatttttgtagacacagggtttcaccatattggccaggctagtctcaaactcctgacctcatgatctgcctgccttggcctcccaaagtgctgggattacaggcgtaagccaccgtgcccggcctactaaatttttcttttttcttttttttgagacggagtctcactctgtcgccaggctggcatgcagtggcatgatctcggctcactacaacctctgcctctggggttcaagcgattctcctgccttagcctcccgagtagctgggactacaggcgtgcaccacaacacccagctaacttctgtatttttagtagagacggggtttcatcatgttagccaggatggtctccatctcttgaccttttgatccacccccctcggcctcccaaagtgctaggattacaggcataagccaccattcctggcttttttttttttttttttttttttttttgagacagcgtttcggtctttttgcccaggctggagtgcaatggcgccatctcagctcactgcaacctccacctcctgggttcaagcgattctcctgcctcagcctcctgagtagctgggattacaggcatgtgccactatgcccagctaattttgtatttttagtagagacggggtttctccatgtttgtcaggctggtctcaaactcccgaccttaggtgatccacccgccttggcctcccaaagtgttgggattacaggtgtgaaccactgcacctggccaatattttttaataaattggcccgacattctggcccgcctctagtcccagccatttcggaggctgaggtgggaggatcacttgagtctgggaggtggaggttgcagtgagccgtgatcatgccactgcgtggtgacaaagcaagacgctgtgttaggagggaaaaaaaaagcagcagacactggcatagccttgtggaagaaaagggtgaatgagagggacccaggggcctgtgtagacccatagggctgggatcttcctcacctagctggccctccaccagcttcctcctcgcagttctcttcccaccgcggatgctccttgctctcccccaagggctgcggttcctggtctttgcatttcacatggggcacgtccacctgcaagcacagtcaggacggaggccaaggagggagaatgaggagtgaacagatcgccctcctgccgacccttcaaccctggtcacctcgatgtgctgctgcgggacggtggggacccgcaggaaagacgggcagggctggggcaggtgccatgagggcaggggcatggggtgaaaggacactctgtccctaggggacaccaggacaccagacctagaggggccgggtgagggcagggctgtgggaatgtaactggaggacctgggctcctaactggtatgtgtgttggctggagtccttcgagaaaggagaagaggtaggagaaaagagatgaggccgggcgcggtggctcacgcctgtaatcccagcactttgggaggcggaggcgggcggatcacgaggtcaggagtgcgagaacagcctgagcaatatggtgaaaccccgtctctactaaaaatacaaaaattagctgacgtggtggtgcgtgcctgtaatcccagctactcgggaggctgaggaaggagaatcacttgaacccgggaggcagaggttgcagtgagccgagatcacgccactgcactccagactgggcgacagagtgatacttcgtctcaaaaaaaaaaaaagaaaagaaatgaaagaaacgggtgcggtgcgtgggtgtttgtgcctttctctactccgttccggccacgcgccatgtgtggaaatcagacccgtcagtgcgtcagtcagggccgggttcagtcagtcaggaaatttgaggccaggcctgatgagagggagccccaatggcaaaggacaagcggccgggctcgggtccgctggagatggctgggatcgcagccgttccctgcctatctgtccgcccgccccacgcgcgagaaggaaacaagcgccgcgtactccctgtcgctccattccgtattttcccgccttcaagctcgcaccctctgcgcatgcgccgaccccgcccctggccagctgcgctcccgcggacgagtgtgttgtgacgcgtgctcccggccccgccctctttgagaacttgcgcggccaactgggcggggccgaccgttaagcagcagtttcgcggtccgcgggctgcgcgcgcagtcggcgccccttgggaacaggacggcgcgctctgggtgcgcttgtgtgcccctgtgaggctcctgggttccacggggcgcccaggttatacggatctcagagtcctgtatttattcggtgcttctaacttcatccactctgccttggaaaatatactccataacaatttttttttttttttgagacaagatcttggtctgtcgcccaggctggagtgcagtggtgcgatcacagctcactgtagcctcgacctcccaggttcaagcgatcctcctgcctcggcctcctgagtagcagtgtcattcaccaggcccttctaatttaaaaatatttttctggccgggcgcggtggctcacgcctgtaatcccagcactttgggaggccgaggcgggtggatcacctgaggtcatgagttcgagaccagcctagccaacatggtgaaactgtctctactaaaaatacaaaaaatagccgggcgtggtggcgggcgcctatagtcccagctactcgggaggctggggcaggagaattgcttaaacccaggacgcagaggttgcagtgagctgagatcatgccactgcactccagccggggtgacagagtaaagctccgtctcaaaaaaaaaaaaaagattgtatgtatatatacacacacacacacacacacacacacacacacacacacacacacaaattatatttttttttcctgtagaaatgagatctcactgtgctgagcccaggctgatccccaactcctgggctcaagccgtcctcccgtcttggtctcccaaagtgctgtctcaaaaaaagaagaaattatctgatctaccctattgactgtaggtcataagacccccgtttcaaagaagtttctgccccacacaaggcctatctatctagattcttcttggcctctctgagcatgcattcctgagactccaagaagaatctagacagacaggccttgctgggtttccccactcagcctattagtattagacgacccccccggcttttttttttttttctttttttgtcttgctctgttgtccaggcaacactggagtgcagtggcaagatctcaactcgctgcaaccttggcctcccaggttcaagcgattctcagccaaccaagtagctgggattacagatgcaccatgcccagctaatttttgtatttttagtagagatggggtttttccatgttgctcaggctggtctcaaactcctggcctcaagtgatccacccgcctcagcctcccaaagtgtcaggattacaagtatgaaccacgacaaaccctttttgtccaatcaaatttctacctgggtgttcaaactttgctgaacctaagcataagacacttttcattaatcaggcatggtggcgggcacctgtaatcccagctgcttgggaagctgaggctgctgtgagccaagatcgcccctacactccagcccagggaacagagccagactccgtctcaaaacaaaacaaaacaaaaacacagtttcccctgtatctctggatcttcattctgaaggcttgtcaggtaacactatgatcaaatacattcgtattccttttctcttattaatctgccttttctcagtaatttttagtgaaacttcagagggcaataaggaagctttctcttcacccctacacagccaaagttcagatttgatggaaatggcaagattccagggtacttgtgtttatttagacacataaatatgtatttaacgacagggtctcactctgttgcccaggctggagtgcagtggtgtaatcacggctcattgcagcctcgacctcccaggctcaagtgatcaacctcagtctctggagtacctgggattacaggcatgagccactatgctgagctaatttttgttttctgtttttgggggacaggtctcactctgtggcccagactggagtgcagtggtgtgatctcagctccctacaacctccacctcctgggttcaagtgattctcccacctcagcctcccagatagctgggactacactacaggtgcctgccatcatgcctggctaatttttgttttttgtttttttttttggaacagagtcttcttctgtcacccaggctgtagtgcagtggcacaatcttggctcactgcaacctccacctcctggttcaaacgattctcgtgcctcagcctcccgggtagctgggactacaggtgctcaccaccacgcccagctttttttttgtatttttagtagagacgggttttcaccacgttggccaggctgctctcgaactcctgacctcaagtgatctgcctgcctcagcttcccaaagtgttggaattacaggcgtgagccaccacgcccagcctaattttttttttttttttttgagacggagtcttgctctattgcccaggctggagtgcagtggtgcgatctccgctcactgcaagctccgcctcccaggttcacaccattctcctgcctcagcctcctgagtagctgggactacaggcacccgccaccacgcccggctaattttttgtatttttagtagacagggtttcaccatgttggccaggatggtctcaatctcttgacctcgtgatccacacgcctcggcctcccaaagtgctgggattacaggcatgagccaccgcacccagccctaatttttttatttttagtagagacggggtttcaccacgttggccaggctgctcctgaattcctgacctcaagtgacccacccaccttggcctcccaaaagttctgggattacagaagtgagccactgtgcctggctcagtacccagactttttttttttttttttgtatttttagtagagacggggtttcaccctgttagccaggatggtctcgatcgcctggcctcgtgacccgcccgcctcagcctcccaaagtgctgcgattacagacgcgggccacctcgcccagcccagtacccagaattttgaccatcaagtggcacactgagctagggggacccaacaagacccctcacccctaaggaaagccaccagatgggggcaactgcccactttattagacaataggtggcccacaggtctcctcagggcccaccctcacagtagacacaccacacaggacaacagaaggaacctgctacccagtcctctgtccctgggattctggtcctgggacaggtgggaaagaggaaggtgggggctggcctcacagaggcctcataaatacaaggtcactggccagggatgcaaaggagcgcagcagcagggactcggggaggatgacctgtcctagagtggcccatgtcacgcagcctcctgtgtgggagggggcctcggctcggcatccaggcggcacaggggactgtcatacaccatctgcaggttcaccttgtggcccaccagctcccggatattgttgatgccatatttgatcatcgttgggcttgtgggggagggaacagagtttatcatgaggtcagcacgtgcacccttctgctcagatttccatggctcccatcttcttcagaggaaaagttcaagttctccccatgacccacagggccctgcgccaactgctctatcacctctcaccctccgccttcagccacaccagcctcctcactcttctcctaatacaaaaagcacattcccacctctgggcctttgaactgactgtgaccactacctgggacacccttccccagatactctcatggtttacctctttatctacctctagattttgcttaggtggcacttcttcctccatgatgccttcactgaccacgtagttgccttagccctccctataccacttactgccctggtacacacttctgtcttcttttgctgagtgcatttgtttttttgaaacagagtctcactctgtaacctagggtggagtgcagtggcgtaatctcagctcactgcaacctccgcctcccaggttcaagtgattctcatacctcagcctcctgagtacctaggactaggactacagacgcacgcaacagtgcctggctaatttttgtagttttagtagagacgggagacagagtcacactctgttgtctagactagaatagagtgcagtggcatgatcttggctcactgcaacctctgcctcctgggttcaaacgattctcctgcctcagcctcctaagtagctgggattacaggcacctgctaccacgccaggctaatttttatatttttagtagagatgaggtttcgccatgttggccaggctggcctcgaactcctgtcctcaggtgatgcacctgcctcagccacccacagtgcttggattacaggcatgtgccaccgcgcctggcctgtttttattctttgtagaggcggagacttgctctattgcccaggctgatctcaaactcctggctcaggcgatcctcctgccttggcctcccacagcactgggatgacaggcatgagctaccacgcctggcctgatgtacttgttggtcttgctagttatcatccttctcgctccactgggaccccagattcagagggagggacataagctgtcatgttcacagcacggggctgagcattcagtttgtactcacgatgaaagttttgtccattggatgaatgaatgggtggtgctgaaaccacgcaggcccctatacctggagagttatttgaggcagctggacaccccgagtttccacttgggcacttaccgctccagggagaggccccaggcaatgaccgacacgttctcgggaagccccatgggcagcagcatctctggacggaagacccccgagtttccgacctccacccacttcttcaggcctgcagaggcaggacagaaaagacgggcagtgcgtgttgagtttctgggcactgctggtacaggttctgggtctaggtggtgagcttgggaggtggggtacaggcatggcaatggggggacccaggccaaaccatagtagcctgagacctccctcccaccccagtaccagggcctaccctgaccttggtggtagctgaacacctccatgctgggctctgtgtatgggttgtaggctggcttgaagcggagttgcgtgatacctgcaggaagtggggggcgggcaggagagcaggggtttggaggataatgctggtgatcaacacacctgcccgctgcctcaccaccatggcccacccctgcccccctgctcacccagcttggtgaagaactcccgcagaacgcccatgaggtggcccaaggtgagaccatgatccgccaccacgccctcgatctggtggaactcagccaggtgcgtggcgtccagggtctcattccggaatacgcggtcgatggagaagtacttgaccggagtgaagggcttctaggggtgacaaccgagccaggcccaggtatgggtcagaaggtccctttgacagcaccctctccccactggggcccccgcctgggccaaccgcaccttctgggcaaggcggtagagcgcacgggcgctggctgatgtggtgtgggttcgcagtaggtttttccgggcctcgtccagcttccagttatacttgtaccttcaggagggaaggtgggaagtccatgcaatggcccaggggtccccagcctccttcccttccataccaggtaagtcctgcctcacccctgtgagccgtagccgccctgagagtgggtccgcttgacccgctggacatagtccattgggagctgcagggcctccgctggatctgggcaggacagagcaacatcaggtcagtcaacgagcatttcccacccctttttttttttcagacagggtctcactgttgtccaggctggagtgcggtggtgcaatctgggcttactgcaacctctgcctcccaggttcaagtgattctcgtgcctcagttttctcatttgtgtgtggcttttttgggttctttttttttgagacagagtcttgttcagttggcccagctgaagtacaatggctcaatcttggctcactgcaacctccacctcccaagttcaagcaattctcctgattcagcctcccaagtagctgggattacaggtgcctgccaccacacccgggaaatttttgtatttttagtagagatggggtttcgccatgttggtcagggtggtctcgaactcctgatctcaggtgatccacccacctcggcctcccagtgttgggattacaggcatgagccactgcacctgggctttatttatgtatgtacgtatgtatgtatgtattttgagatggagtcttgctctgttgcccaggctggagtgcagtggcatgatcttggctcactgcaacctcctcctcccaggttcaagcaattctcctgcctcagcctcccaagtagctgggattacagaagtgcaccaccacacacagctaattttttatatttggtagacgtgaggtttcaccatgttggccaggctggtctcgaactcctgacttcaagtgatccgcctgcctgggcctcccaaagtgctgggatcatgccaccgcgcccgacctttttattttttctttttttttgagacggagtctcgctctgtcgcccaggctggagtgcagtggcgcgatctcggctcactgcaacctctgcctcccaggttcgagtgattctcctgcctcagcctcctgaatagatgggactacaggcacacgccaccatgcccagctaatttttgtatttttagtagagatgggatttcaccatgttggccaggatggtctcgatccacccaccgtggcctcccaaagtgctggaattacaggcgtgagccaccgcgcccggcctattttttttttttaaagggacaaaattttttttttttttagacggagtctcgctcagtcacccaggctggagtgcagtggcatgatctcggctaactgccagctccgcctccagggttcacaccattctcctgcctcagcctcccgagtagctgggactacaggcgcccgccactatgcctggctaattgtttttgtatttttggtagagacggggtttcactgtgttatccaggatggtcttgatctcctgacctcgcgatccgcccgtctcagcctcccaaagtgctgggattacaggcgtgagccaccgcgcccggcctaaagagacaaagtcttgctctgttgcttggcctgcagtgcagtgatgcaatcatagctcactgcagcctcaaactcccaggctcaagcaatccttcacctcagcctcccgagtagctgcaactacaggcgtgcactactatgcccagctaattttatttgtacagatgggtctttctatgttgcttaggctgttctcaaactcctgggctcaagcgatcctcctcccttgccctcccaaacagtgggattatacccactgaggctggccaagtttccttctttgtaaaaaggggtaacagtactgcttccagtagttggcaggaagattagaatagtggctagtatgtgatgagtgcttagtaagttttgggtgctatgacaataatgacaagaatgatgttgctcctctggccaggtaagccggcacccaatgacctcaactgccctcttggtcaggaaggccaccccattgtgggaagtcattccatttcagacagtgctaagggcaatgaaagaaagaaatgggacagaagaatgaacactaggggagaagggcttctgtagaactcggggtgagcccgggagtgttaggctggcctgtctctggtgacacgtgagcagagatttgaggctgcagcctgccttgaagatctgggagaaaacagctcttggctaaagacggaacataagcaaaggccctgaggtgtgcacggcctggaatgcccaaagaagacatgggggcaggcagggtgtgggggctcatgcctgtaatctcagcactttgggaggctgaggcaaaactgtttgagatcaggagtttgagaccagcctgggcaacatagtgagaacaaaacaaaacaaaaattcattaattttgggctaggcgtggtgctcacgcctgtaatcctagcactttgggaggctgaggcgggagtatcacttgaggtcaggagttccagaccagcctggccaacatggcaaaccccatctctattaaaaacacaaaaattagccgagcgtggtggcaggtgcctgtaatcccagctactcaggaggctgaggcaggagaatcgcttgaacccaggaggtggaaattgcagtgagctgagatcgtgccactgcactctagcttgggcgacagaatgagactgtctcaaaaaaaaaaaaaaaaaaaaaaaagccaggtgcggtggctcacgcctgtaatcccagcactttgggaggccgaggcagactggagtttgagaccaccctggccaacatggcaaaactccatctctactaaaaatacaaaaattagctgggcatggtggtatgcacctgtaatcccagctactcgggaggctgaggcaggagaatcgcttgaacctgggaggcaaagtttgcagcgagccaagatcgtgccactgcacactccagcttgggcgacagagtgagaccctgtctcaaaaaaaaaaaaaaaaaaaaaaaaaaagactgcaggtggcataatgagaacagagcttgacacatccaacaaggatggactttaatttaactcaattaatttttttagaggtagattcttccctatgttgcctgagctggatttgaactcctgggctcatgcaatcctcctgccttggcctcccaaatagccggactacaggtgcacaccaccatgcccagttctagacctaatttgatcaaatgggatgcccatcctgtaaaggctccgccgtggcctggtgtctctcatgtctcagggaggccctaggggctgacccacctcgaaggaagaaggtgtcgtgctggtcacgggctgggtgctgctggggctggaagagggcgtcaaagttccagaaggagctctcaatgaagttatcagtcggcatctcggtgaacctggtgggagacgcagcctgactgccctgcctgtacccagcagaagcaccaggcaccgcccccagccctgtgctcaccccatctccaggaagatctgtcggaactgggagcggaccttgagcagcgggtgaaggtggccgctgtcggggaggacaccgtgggccaagaagttgtagggcttgaagggccggtcccgccaagagccactgggggaggatgcaagggcctggtaagggctgcccgcccctgccccctgccccagctcccacctgccctgaccctggggttgcctgctacctggagatcatctctgggctcagctctgtctcttgcttggagatgctggtactaaaggcactgcctttgctcacccagtaggtcttcagagtcctgtggccaggggaaggaaggggacgccactgccatctcctcctagaggacttccttgatctcccgtctgatgaggatccccatgctacctaccaagtcactctgctttatttccatcctgacatttatcactacctgaaatcctcctatgtgaccatgctgtatctccctgtattcactcactgattcattcaacacttactgagaacctaatgtgtgccagggtctgttcaaggtgctaagtacacgactgagtgatgatactagggaaagtctagcagatttattctgtgccaggctctgttctgcaaaagtctccccacaagccccggaaagagggcagttttttttatttgtttgtttgttttccttttttgagacagagttttgctcttgttgcctaggctagagtgcaatggcacggtctcagctcactgcatcctccacctcccagattcaagcgattctcctgcctcagcctccagagtagctgggattacaggcacccgccaccacacccggctaagttttgtattttcagtaaagacgaggtttcaccatgttggccaggctggtctcgaactcctgacctcaggtgatttgcccgcctcggcctcccaaagtgctgggattacaggcatgagccatcgtgcctggcccctttttctttgagatgggggtctctctatgttgcccaggctggccttgaattcatggattcaagtgatcctaacacttcagcctcctgagtagctgggattacacacgtgagccacacacttggcccaggctattttatagataaggaaacggagaccagcaaaggccaggtgacttggccaaggtcataaaactagttaagtgacagagcccgaacttcagttaggcatcccagctctagtctcttctctctgccactctgtgtctgctcaaaggggacatttgtcctgtgagaggacggcccctagcccatctaggttccagaagcctgtctggtgtgtgttcattaaactttggaccacactaaggacagtgaaagaaatgaacaagcaccaaagatgaagactaggggcgatgggcttcatggaactcaaggggagaggagggctgtcagggtggcctctttaaggggacacaggagagagacttgatgaggagcctatcttgaagatcagagggaaaacagttctcagcagaagggtcctcatgggcaaagaccccaaggcacgtaggcttgacaactatggcattaagcgagctgggaggaaactggccacacctgtgcttggtgtgggcaagatgtctccctcccaccatgcctccaccatgcttcgcaggtggtgggggcctgagcctgcagggggcacccactcacacttcagccaacagcttcctcttcctcagctcgctcctctccttctcccccagcttctcagcctgtcccccccggaccagctggagccgccgctgcacctcatcctccatgctgtccacctgccaggataaggagtgtgaggggtatgagggccaggggcccatgtgcccgtccacctgccccctgaccagcccgcaggaacgcaccactcggaacacccggggcccgtcagccgcactcttgtccacccgaatccacttgttggacatggccttgctgaagcccactttgccactgggcagtcgctggaaaagagaggctgcagtgagtggggcacgagggccaccttcatcccatcactcactccccattcaccccgcagctcctaccataagctcgctctgggccaggccctctgggggaatgcttcgaaacacacgggcctcatggctgccctcccgggcaatctcctcgccctccgcagtaagctcccagtgcttggtggaccgaagttcagcctcgatgacctagagggaaatgtggggagggtgtccaggcaggggtgaggctcagagccaggcaccccctttctgcagcgctgggtcccaggttgaaagcacagcccttaaagctaggttcacatcccagctatacaactttacagccaagtggtctcaagggaaagacttccccttgctgtgtctccatttcccttatgtaacacaggggtagtaataatgatagtttacacctcccagggtaaagtacaccactaaagatgttacctggcagaagacaaattctgtcggttttgaacctgtgacagattttaatgtgaaaaattaggtgaactgatatgtctccacatttttttgtttgtttttgttttctttgaaagggggtctcaccctgtcactaggctgggtgcagtggtgtgatcatagctcactgcagcctagacctcctgggctcaagcgatccttccgccagtcccgagtagctgggactacaggcatgtgccgccacacctggttaatttttaaattactttttttttttgagacggagtcttgcactgtcgctcaggctagagtgcaatggtgcgatctcggttcactgcaacctctgcctcccgggttcaaatgattctcctgcctcagcctcccgagtagctcggattacaggtgcccaccaccacccccagctaatttttgtatttttagtagagatggggtttcaccatgttggccaggctggtctcaaactcctgacctcgtaatcggccgactccgcctcccaaagtgctaggattacaggcgtgagccgccgtgcccggccctttaaattactttttaaagacagggtgttgttatgttgtccaggctggtctcaaactcctggcctcaagtgattctccttcctcagcctcccaaagtgctggcataatgggcatgagccaccatacccagcctgtctccatgtttaaatgttcacatgtcagtgcccagaatgtcagagacgggccctggaggtccacattacaaacaaaaactgaggttccaggtccagagtcatgaagacaaggacaacaagggtaagtagagtgcacagggcctggctcccacttcattctaatcccaactctgcccttcacttactgtgtgacctcaggaaagttgcttaacctctcagtgactcttctcatccataagagaaaggtgtgatgggttctacctcagatgattttaaggagtagctaaattaatactcagaaagaatatatagtgcctaccacgtgacaaacactgcataaatttttttttttttttttttttgagacggagtctcgctctgtcgcccaggctggagtgcgatctcggctcactgcaacctccacctcccgattcaaaaaattctctgcctcagcctcccaagtagctgggattacgggtgcccaccaacacgcctggctaatttttttttgtatttttagtagagacagggtttcatcatcttggccaggctggtcttgaactcctgacctcgtgatccacccgccttggtctcccaaagtgctgggattacaggtgtgaccactgcacccggcataaattctaattactataattatttttatggctattactgtcattagattgaacctcacctccttatattatttaaccctctgtgacgtatacaaatgtcagatcatattggtcaaggcactgtcaccccacacaacacagctgccatctctcctctgcattgaggactatgggctctgcagcctgagtgcctaatttcaaatctgggctcatcggcctcttctattcacactgattatgttactgaccatcagttgtcacatctgcaaaatgggaataacatggccatcagccaggattatggaatggattggacaaacaagctgagaccaaagtggggcacagaacatgagctctacggataaacagcccagatcctggccccatggatctagccttctgggtggcccacgggcccctcagcatcctacgcctgtgactctgtcactgtccacttgcccaagtcagaaggctggacttcatctgtgcgccccctgccttgtcctgaatcccacgccttccccacctcccccaagcttccttcccatagccagacatcatgccctccagcttggggaagtgccagcttcttctttcatcccttcacctccagtcctgtccatgccaattcttcccaaaggtgatgtggatagcacactcatctgaccggctctagctcctgctatcgcttcccagttccctcatgaggtaaagacctaagaggctttgcaattacagctatgctggtctcccttgccgcctgccatcccccaagatcccggccactgatctctaaagtgctatcactttcctcaacagagaacagactcagccgtcacctgcaccaggccgctctccctgacccccaaggctgggtcagctgtcacagctgggtcccctgttttcccccatcactctggttcttgaagcaccttcctattacgtcgcaacctgcgtgagggcagcaaccgcgcttcctcgtccatcatcgtaccctctacccacgctgaccgtgcctcaataaacgtttattgcatgaggaacatccgtgcgtctgggccctcactcgtcccacttcccgcccgcacatcccggagtggacacatatacagctaccccaaactaggcctgagggaatttggcttggacgtagagcgcccgtggcaaggggactgtaggtgcaagggcaaggcggtccggcatcacgggcccggctcacctcgcccagcgcctgaaggctcttcacggcgcccaccaccgcctggtgctccatgcccagctcagccgccaactcggcgctgtccaggccgccatcagacgcctccagccgccggagcagcagttccgccacctgaccatccgccatgactccttccagtgtgctcagcgtgtccgggccagggtgggcggggggagctgagccaccggaaccggaaccggagtgtgtaccgccatcttgaatgtgtctaactgtagaacagggctcaatgtgtcgtcatcttgagtgtggcgacggagccgcaaaaggtgcatgggactcagttcccacctccaccctggctccatcaatggcgtctggttgaccagaggggtaaaattgattatctcaaggtcagaagcaccgccctgttttgagttttatctagcctcacttcgagcgggctgtgtgaccttggacttccccgtctctgggttacagaaccctctgcccttctggtattctctcttgccctaggagaggcggtgggtggtgggctccagagatggtcattttggcgatgtcagctacttttaaaatttcaaaggaaggctgggtaggtaccgtccctttttatagagggaaaaggaattcacctagtaagtcaaggtggcacctaacctgtgtggactacctcgtatgtggtagtacttagcccagaactgagtacttcacgtgtagtatttcatttatccccaaaactttatgatgtagatactgatataaccgcattacacatgtgagaaaactgaggctcagagggtggtatgacttgcccaaggttctacagagagttggtggaaatgaagtcataaattataaaccttccagatcctcccacccctgtgcgctgagagtaacgtcagtgcaaatactgcatggcctagattagcactgtcctatagaaacacagtgcaaaacatctttcttttttgagacagggtcttgctctgtcacccatgctggagtgcagtggtgcaattatggcttactgcagccttgacttcccaggctctaaggatcctccaaccttaggctcctgagtagctggaactgcaggtgcgcgccaccacacccagctttttttttttttttaagtatgggttttggccatgttgcccaggctggtctcaaactcctaggctcaggttatcctcctgcatcggtctcccaaaatgctggcattagaggcatgacccacctcgcccagccagccagaccctgactcttacaaaaaaaaagatgactaataaaatattttgcactcggccgggcacagtggctcacctctgtaatcccagcactttgggaggccgaggcgggtggatcacctgaggtcgggagtttgagaccagcctgaccaacatggagaaaccccgtctctactaaaaatacaaaattagcagggcgtggtggcgcatgcctgtaatctcagctacttgggaggctgaggcaggagagtcgcttgaacctgggaggcagaggttgtggtgagccgagatcgtgtcattgcactccagcctgggtgacaaggcgaaactccgtctcaaaaaaaaaaaaattgcactttttttcatactaaatcttcaaaatctgatgcgtattttacacttacaacacatctcagttcggaccaaccacatttcaaatggtcagtaatcacatgtgggcagtggtgacttacgtcagcacaggtagattagaatcctagatctgctggccaggctcagtaatcccagcactttgggaggctgaggcgggtgaatcacctgaggtcaggagttcaagaccagcttggccaagatggcgaaaccccatctcctctaaaaacacaaaaattagctgggtgcagtgggggtgcctgtaatcccagctacacgggaagctgaggcaggagaatcacttgagcctggtaggtggagcttgcagtgagcagagatcgcaccactgcactccagcctcggtgacagagcaaggctctgtctcaaaaaaaaaaaaaaaaaaaaaaaagaatcctagatctgttatttatgtcattcaaccagaaggtgtagtctttctgtgcctcagtttcttgctcacatggaggtgattggagcccaggttactgtgagaattaaatgcccacacatattcacactgcttactaaattgagtgtggcccatgttcgaacactcttataagcagaacacatttattccttttacatcacaattattatttgagtctgtaaaatgggattactcatatccccaaatcctgaccctatatgaggttctgtattaaggatacatttctcaaagtcccttctctcctcccattttatgttgattatttatttatttatttagggagtgggtctcactctattgcccaggctggagtgcagtggcatgatcttggctgactgcagcctccacctcctgggctcaagcaatcctctcacctcagcctcccgagtagttgggactacaggtgtgtaccagcaggccaggctaatttgtgttatgtatattatatattatatgctatatataatatacatactattcatatatttatgcattatatgtcatatataatatattacatatgtgtacatatatatattttgtaagaatgaggttccaccatgttgcccaggctggttttgaactgccgggctcaaacaatctgcctgcctcaggttcccaaggtgctaggattataagtgtgaactaccatgtccggcttatttttatttatttttgagacagggtcttgctctgtaacccaggctagagtgtgcagtggcaacaacacagctcacggcagcgtcaacctcctggtctcaagtgatcctcctgcctcagccttctgagtagctgggaacacaggcaggcgccaccacgcctggcaattaaaaaaaatgtttttgtaaaaatggcctcctgctatgttgcccaggctggtcttgaactcctggccttaagcattcctcccatcttggcctgccaaagtgttgggattacaggcgtgagccactgtgccccgtgtgtttttagttaatttccacaagagtccttccttcctctcttctatcatgcagcaagtactttttaagcctgttctgtgccaggtgctgcaggtgacactggaggatgcgaagtgaacaaaacaggcagtgtctaacctcaagtaggaagcgccaagcccacaggtgcctgacacaggaacaggaggaagggtcagcaagaggcctgggatggtccccgggatcctcatgggggggaccagactaggcaatactgaatactacctagaggaagtggtagaaccccaacttcccagttcattctcccccgtctttttttcgagatggagtcttgctctgtcacctgggctggtgggctggagtggagtggcgtgatcttggctcactgcaatctctggctcccaggttcaagcgattctcccacctcagcctcccgagtactgggattagaggcacccgccaccacgcctggctaatttttatttatttatttatttttatttttagtggagatgggttttcaccttgttggccaggctggtctcgaactgacctaaaatgatctgcccgcctcggcctccccaagtgctgggtttacaggcgtgagccactgcgcccggccaccatttcttttttttttttttaaccagagacccttgccaagtcattccccccactccactttattttccttttcattttttccttcctctcttttctgagtcacaaccattagccaggaagcaccccctccccaccctctttcctggatccccctcattccctccttccatagtccactcccgcgctcccaggtccagggcttatttgcccagagtttggaaaacccccagctctccttcctcctttctacagcgtgggggcagggtactggtgccagtcacgtgcctctggcttctgaagaagactctagactggggtcggggggtgggtcctgcccatctccctagcatcttatcgtccctaccatctgtgtcttttttccctccccaaacggaaccccctgccctctcgcctgcctatagccgtttaattgcaaaagccaggccgtttgtgggagaccacagacagcgacccccttcatttaccggttgagaggagggtaaaggggcggctgcaatctgggtaataaccctatccccactccaggagtcacagtcacatcgttaagccttcctcccctcttgtcccaggacagctttaaaaacgttaaaagcatttctgctgggtagcatctggccagggtcgccccctctgtctgctcaggaacgtctgtcacttcagagagcttaagtgacttgccccggtcacacagcagcagtccgataggctgccagggctctaggggcagaaggaggagagggctggcattcttcccaccggcccgcgtgactgtagcaccggggtgcagcgaagccccaagggccccaatccgtgagctctctcccatcccaggcaggggtgggggagcagcagtggggtgctggttctcaaatgcaagataagagctggctaagaaagccttgcccagcccctccacctagagggaatgggagggagagaagctgagggcagggtcccggtcccgcgtggagacagctgcgctcccgcggtttctttaaacgcccagatgggcaacgacgcgcgcggacgagggcggggttgggttcaggtctggtcacatgacctggcctgaggtgctcgcggcccccaccccaccagtgggcgtcccccccacgcgtggtcgaccatcattggtcggtggtgaggccaatagaaatcggccatctgggaacccagcgttccgaggcgcagcctaacatagtgaaccgacgaaggtccaatggaaaaagacggccatgggcatagaccaatgacaaagtggcaggggcgggcccaagggctgggtcaggttggtttgagaggcgggtgggtataaaagtgcaaggcgggcggcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgcccggtgtggtggtgggcgcctgtagtcccagctactcgggaggctgaggcaaaaggatgacgtgaacccgggaggcggagcttgcagtgagccgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaccacaaagctggggtttgaacctgggcagtacagcacctgagtctctccatcttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcccccctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagcccaacccctctgggatgcctccaggactggtagatccaagggagaattctgtatttaatgtagtgaggctttgaaagttaacatctttaaatacttctggggtcagattaggtatagtacaacaaagtactcctgcccggagacccaagaatgaaaattgtaggttcattccaaaactccagatccctaaagaatgaatgaggctacaaaatggcaccttgcccccgcttccaacttaaggttttttttctgtgcttggtggcctttcaggtatttctagttttgagtaactttcactttgactgctctacaagggttcctgccaggatacccagaccagaataaaactcatttgggggccgggtacggtggttcacgcctgtaatcccagcactttgggaggccgaggcgggtggatcacctgaggtcaggagttttgagaccagcctggccaacacggtgaaacccaatacaaaaaattatccgggcgtggtggggggtgcctgtaatcccagttactcgggaggctgaggcaggagaattgcatgaacccggaaggcggaagctgcagtgagccgagatcgcgccactgcactccagcctgggtgacagagactgtttgaaagaaaaaattctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgcgggccgggccggagcccgggggcgggagcgacgggtttcgggggtggggtgggggcggggaggctagaatcccaacgggaggggcagggaggacggcgcgggtcggccctgcccagacccccgacctgcccgactttcctggaccccccgatggtctttggcccagcccccagccgatcgggcggcgctcctgcgccggtctccgggcgaggccccacccccggggcgctggccaggccccggctccaatgtcagcgctctcgcggggcgcgggagtcacaagctcggattcctgggcaggccaagctctccaagactgggctccacgttcccagctttgcaggcgtctccttgggacactggtggtcgaatctaggagtaatgaccaggagatactgagtagtgacgacaacaacgatgttaatgataataaacgggtctcagtctttataattttggtggtccgtgtttgttggccgtttactttttatcagtcaccgagtgttgtagtgttgttttaccgctctgcaaaacgggcttgtcattggggacctctgatcattttacagatgtggaaacctagggattgaggaactttgccacagtcacacacaagtaatggcagagctgggattcaaattcggttctgcctcgtgtgagcgtccacgatataaatattatgctgcctttttagtcaaaagtagaattaggacctaattcaaacatactgaatgtctattgggtacttggcgctttttgcatagtgagggagacattgaagtccactttttgtagaaaaggaaacacacattttttgatccgctcaagtgtttggctttgggcaagttaacctgcctacctgtctgtgcctccgttttctcaaatatcaaatgaaccggtcgcctgctggcttccgcctgtaatcccagcacttagggaggcagagggaagaggagcccttgagcctaggaattcgagatcatcctggcaacacagtgagaccccgttctctacaaaaaaaagaaacaaaaatcaataaataaaatgagaccaattaaacgtatttcataggaaacttaaaaggtatgacacatatacatttacagtagcactattggccaggcacggtggctcatgcctctaatcctgatgatttgggaggcagaggcaggaggattgcttgaggccaggagtttgagaccagccagtctaacatagggagacttatctacaaaaaaaaattatttttaattagtctggagtggtggtgtgtacctttagtcctagctactcccaaggctggacaagagtaccagttgagcccaggagtttgaggctgcagtcagcgatgatcgtgccacatcaatccagcatgggcggcagcgagatcctgcctcttaaaattaaaaaatatcactattaactattagtcacttattgtccaaggtagagtgtagagtgggggactgtcccctttattctgttaattatactttatactacccgaaattacattttcttcacattagtgttctctcattgagagcagggacttacttgtgttgagtttgttctgtgctgtggcctctgtgtctaaaacagcacctggcacataatgggtgtttagtataagtaaatactgtgttgaatggcatgatgattgaatgaattcaaatctagcatgctttagatgctgagaaagcttaaaaaacccagcgtgcttgcctttctgccatcagggctggcagtttctctgtcctaaactagaagggaaaagagaatcttggggtctccagtgactgtctgtaccactccctctaggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaaggtgggtgacgtgtgctggctgggagggtgggtggacgagctggggagctggcaaagagcctgtgtgcccaggagagattagctgtgaacagggcggggccacagcggagcgggttgttgggtctgatagggttgctgatgccagctccctttttcttgctgttgcagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcagggtaaggcgggggcagcagtcccagcttgggccctgtcctcctagcacattccagcgtccacataagtggtcccacacacctggagggagggcaagccgccagaagccagggtccgatttctctctcttgaatttgcagctctgttccctcttcaggtagcagcgggcgagaggaagacgcggcctccacgctaggtgggtgggtggtccccagggcagaggtgactgggtgccccagccatcagctgggccttgtctgggtgcgggagggcctgggagctgccctttcctcttcctggtgacctaggctttgctgcttcctccacagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacagggaattcctgggagccccgagccggaacacggttctgtccaggagagccaggtatcggagcagccggccacggaagcaggtgggtgtgcacatgccgcatctgccctccaggtacctgactcacattacactccaccccgcagtgctcctaggagcccggcgtggtgtctgactgcaccccttcctactaccagcaggagagaaccccctggagttcctgcgggaccagccccagttccagaacatgcggcaggtgattcagcagaaccctgcgctgctgcccgccctgctccagcagctgggccaggagaaccctcagcttttacaggtgtggtcccaagggcagagggagctagggcagccaccatttcccttccctgtgggcaccagagtccataacacgtaggaatcgttctaggtccggaaagcaggactaagcacatgcttcccccacgcccctgtgcttcctgtgacctggtgacccccctggtttctcagtcttcccaaccaccttgtaaggtgtgggtgctgtcaacatcacctcccacagaagaagacaccggaaacttagagcagcctgtcattcccagggtcacgcagctggtagtgtgtgtgtctgcctcctgcctcggggtggggtcctgggctggggctctggcttcacatacagatggtgctgcgtaaatgtctgtaaggtggcatgacgtcacccaggacagctgtgccccagttggctctgggacaactctgctcagtgaggctccatcttgcccttgaaggttcacaggaagagtgggggagtggccccctgggtgcaagtaggttcctctgggttctcggtgaagtgcctaccggtcttggctcaggaccctgctgtctgacccttctcctctcacttctcagtcccttgccagctcctcctggtcggtcgtgttcttcatctgcactcagccctccctcatagtgtcctggggccttcagtctgtatgggaacccccaaatctatgtagccagcccaggcctctctgaatgccacactccatggctggcttaattaactctccatcaaagtgctccctagactagacgtctaagacttagaacagacctccccagtcctccccgatctctgcaaggattagcttggggttgcttcagccccaggccctggggatctgctggggtctaccccttgtcctgtctgctcttcccactcagcccctccctgcactccagctctctggtagcctcttcctgggcctctgccactgcatagtcccacagtccacttttcaaccatgaggcagatgactaaaaagcactttcttttctttttttttttgagaggaaatctcgctctgtcgcccaggctggagtgcaatggcgcaatcccggctcactgcaacctccgcctcccgggttcaagcgattcttttgcccccgcccgagtagctgggactacaggcgcccgccaccacgcctgactaattttttgtatttttagtagagatgggatttcaccctgttagccaggatggtctcaatctcctgacctgatgatctgcccgccttggcctcccaaagtgctgcaattacaggcatgagccatcacacctggctgactgaaaagcactttcttctttaatgtgaaaatgatcagatgcatacaatggtagagttatatcagagcttccagatacccaggtagggcacagtggctcatgcctgtaatcccagcactttgggaggctaaggcaggcagaccacttggtcaggagttttagaccagcctggccaacatggcaaaaactcgtctctactataaatacaaaaagtagctgagcatggcggcaggccactgtagtcccagctactcaggaggtggaggcaggagaatcgcttgaacccaggaggcagaaattacagtgaaccgagattgccccactgcactccagcctgggtgacagagtgagagtgtctcaaaaagaacagaaacaaaaatgaacaaatgaacttccagatacctaaatccaacacccagatgagttcactttttttggtttgggggctggtaggtgggaatagagatagggtctatgttgcccaggctggttttgaactcttgggcccaagcagtccctcctgccttgcctcccaaattgttgaggttacaggcgtgagccaccacacccggccaagttcacctttctaaaagatccacagaccacgtcttttcccatgtaactgtcaccaccgtggcttccccctgctctagaaaatgggtctgacttgggccttcctctctggtgtcattgtctgcctcctcccccttcccttgttcgctgttttttgttttttttgttgttgttgtttgtttgtttttgagatggagtttcgctcttgttgcccaggctggagtgcagtggcgtgatctcagctcaccgtaacctccgcctcctgggttcaagagattctcctgcctcagcccccagagtagctgggattacaggcatgtgccaccacgccctgctaattttatatttttagtagagatgggatttctccatgttggtcaggctgctctcaaactcctgacctcaagtgatctgcctgcctcagcctcccaaagtactgggattgcaggcatgaggcaccgtgcccagccccattcactctgttcctgcttctgtttctgagacttcccagatgcatccaccctgggcctttgcacttgctgtttgctttacctggaggaaaccctctgcatctgccatactgcaggcctctccaccagccctcatctgcagttccttcctagccagacacttgcagttgtctggttcatttattggctcactcacttattttttgagagtctcttgcccaggctggagtgcagtggcacagtctcggctccctgcaacctctgcctcccgtgttcaagtgattctcctaccttagccttcttgagtagatgggattacaggcacgtgccatcacacccagctaatttttgtattttagtagagacggagtttcaccatattggccaggctggtctcgaactccaggctggtctagaatcacctgaagtgattataggtgtgaaccactgcagccagcctatttatgtatttatttattcaagacagggtcttgctctgttgcccaggctggagttcagtggcttactgcagcctccgcctcctgggttcagtcttatgcctcagcctgccaagtagctgggattacaggcgtctgccaccacacctggctactttttgtattcttagtagagatgggggttcaccatgttggccaggctggactcgaactcctgacctcaagtgatccacctgcctctgcctcccaaagtgctgggattacaggtgtgagccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtaagaggcctggctgaggggtgactgcaggtgggcaggacccctaccctctcctgctcacacttaacctatcttcccacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctagccttggcctccagcctggagaagggctaacatcagctcattgtcaaggccacccccaccccagaacagaaccgtgtctctgataaaggttttgaagtgaataaagttttaaaaactagccctatggtctgtgcctgctggggctccccgcgcccacctgtctgggtcttggggggctggctgggcacaggcaggcatggtgacgggtgcctggaagggggagaggagtctgtgagtccctgcagattgaggcttccggtgtctcctcccccagtgtgtcatttccaggcagtggaccccagcccaacgttacaaggactgcttctccccggcccccaccatcatcaccacagtctgttttggctatacttccccccccaccagccttgtaattggctaattactggagatgaatgttggtaaacagaagccttcttctcttctgccatctgcttctccattatttgcccattgtacaccccccttttcctcccactgaagccccagttagtcagcagggcctagagtccctgtccccttttgagtacagccaagtgggggattccccagctcttaagtattgggggaggaaccaggggacccagagaggcacaccttgagaggacgcagatctcttcaggggtactgccaggtagcaggctttattgggaagggacaaagcctcaggagctgggtgccccagaggctgctgggtcttgagccacagctgcagccaatgcagcagctcgcgcctccttcttccgtttctgtttttcctccttgaggcgcttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctgcaggggagggagagtgggctgtgacactggcactcagccagggcagagcccacccacccatatctcacccataggcctttgcccacgagcctgcctcctcaactcccccagtagattaactgtcaggaaaagcccttgacaagtgaagaaacaggaagagatgatgagaaagttacctgtgcatgaatttgatcacaagggcatgtcaagccccagtaaaccccaggtgccaaagccaaatcagcatttcactgagctgcctactgagcaagccaagtgccactcccatggataatttcacacctttatttcatagacattgctgagcacttcctgtacagaggccaggcccaattctaggcacaggagtgaaagcaagaaagacatttcccaccaatccttgagtttgtagctaccagtcacagccccatttttttcttttaagttcaggggtacaagtgcaggtttgttacgtaggtaaacttgtgtcatggggtttttttgtacagatttatttcatcactcaggtattaaacctagtacctagaggtcatttttcctgatcctctccctccaccctccaaaaagccctagtgtgtgttgctcccctgtgtgtccatgtgttctcatcatttagctcccacttacaagtgagaacacgttgtatttggttttctgttcctgtgttagtttgctagggatgatagcctccagctcccgtcgtgtccctgcaaaggacatgatctcgttcttttttatgacagcctcatttaaggattagaaaagtaaaagaattaagccctataatggtcatctggctgaggaggggcagaaacaggagtccctgctccatgattccctgcctgggtgatcagacgcatgacttcacttcaccaagcctcagtttcctcatctctaaaattagggcaatcccttcttcctcttaaggctattaggaaaacaagaagattaaacaccaggaacacacttgacctacccccttcacgctccaggatgtggcattatctataagagatgcccctggtctggcccgacgcggtggctcacgcctgtaatcctagcactttgggaggccgaggcagatggatcacctgaggtcaggagtttgagaccagcctggccaatatggcgaaaccccatctctactaaaaatacaaaaaatgagccgggtgtggtggtgggcgcttgtaatcccagctactcgggaggctgaagcaggagaatctcttgatcctgggaggcagaggttgcagtgagctgagattgcactccagcctgggcaacaagagcaaaactctgcctcaaaacaacaacaacaacaacaacaaaaagatgcccctggtccttcagacctgcctctgtatctgacctctgccctcttggttccaggacccatcaccttcctgccctcaccttttccccagccacactggcttcctggctgttctttaaggcatatcgtatctcagggcatttgccccagctgttccctttaccagaaactttctacccaagagatcgccccatagctaagtctggttattcaggtctttgcttaaacatcacctcctcagagaggcctgaggcttcccaaaccaaagctgccctcaggcacacactcttcactcttttaccttcctactagtcggctgtcaccattggtattatcttgcctgtcagctgtcgccatctgatattaagggcccttttggggcctgcctcggcctcccaaataactgggattacaggcacgagccaccgcccccggcctgggacagggtcttgcacacggtatgcgctcagtaaagacttggtggtgatggccggacgtgatggctcacacctgtaatcccggcactttgggaggctgaggcaggtggatcacttgaagtaaggagtttgagaccagcctggccaacatggtggaaccccgtctctactaaaactacaaaaatttgccgggcgtggtggtgcacgcctgtaatcccagctacaccggaggctaaggcgggagaatcgcttgaaccggggaggcggaggttgcagtgagccaagatcttgcgactgcactccagcctgggcaacagagcgagactcttgtctccaaaaaacaaacaaacaaacaaacaaaacttgctgatgaatgactaaatggacgttattctgagtttgttttgcggccaggtgagcgtatacataaatctacaacatgcagatgctgcgacgtgaccccgaaggggtaggcacggtttggggcccagttcgcccacggggcacagagggcagccccgcgtctgcctgcacgcacgcacctctcccgacgcttctgctcttcggccagctgcttcacccgcagcgactcctgcatggtcgccaggctcgggtaccattcgcgttcttcggcctccagctcccgcagctgctccggcgacggccataacgaaccggggaccaccccggaggcggcgccgtaacgcgcgaactgcttagccgcgtagcgcggtcccagctgccaccgcggggtcaggaggtcctcggggtctggccaccggggtcccggcctgcggcgcgggggcggccgcgcccggtagccacgggaacccggggccagggtcgccgccacacctagtaggctgcgtgcctgtcgcacggacgccgccatcttggctgtgcggggtcctcacaggcccgccgggctgtccatgcccggtgcctgagcgcgaggcccggtgtgggccagggcagggcgaggggtgtccctgctgcctcagttcgggggagggcggcgaaggggatagtatgggttttatacgtttccaagtataactttaaattttagttaagcagttactgattaaagtcatttttaattttcactttttttcttctcctttctgcacactgacacttaaaaatacatatttttgtcgggcgcggtggctcacgcctgtaatctcagcactttgggaggccgaggcgggcggatcacctgaggtcgcgagttcgagaccagtcttttttttttttttttttcgagacagagtctcgctctgtcgcccaggctggagggtaacggcgtgatctcgggtcactgtaacctccgccttccgggaggagaggagaaaccccgtctctactaaaaatacaaaattagccgggcatggtggcgcatgcctgtagtcccagctccgcgggaggctgaggcaggagaatcgcttgaacccgggaggcggaggttggggtgggccgagatcgtgccattgcattccagcctgggtaacaagagcgaaactccgtctaaaaaattaataaataaaaataaatacatacatgcatacacacacacacacatatacatatatatatacgctcacctggctacaaatatatatttgtgtatttttttctaagtgttcagtgttctttgggtaaaaattgtatttttgttttttgcatatcagaaaccatactgttttattcatccatgtgtcttctgtgcacacagtagccctccaatgaataatctgaaatcatgttgaatgaacacattgaaaaatcaaaaataagaggctgtggcagggccactgatatggtttggctctgtgtccccaaccaaatctcatcctgaattataatccccatgtgtccagggagggacctgtaatccccacatgtcggggaagggaggtggttggatcacgggggtggtttcccccatgctattcttttttttttttttttgccttcaaaaagtttattttattttattttattattattatactttaagttttagggtacttgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtgatgttccctttcctgtgtccatgtggtctcattgttcacttcccacctatgagtgagaacatgcggtgtttggttttttgtccttgagatagtttgctgagaatgatggtttccagtttcatccatgtccctacaaaggacacgaactcatcattttttatggctgcgtaaaaattatatttttaactttacttttatacatttaaactagcatttattaggctgggcttggtggctcacgcctgtaatcccagtactttgggaggctgaagcgggcggatcacttgaggtcaggagttggagaccagcctgaccaacatggcaaaaccttgtctctactaaaaatacaaaaattacctgggcgtggtggtgggcgcctgtaatcccaactactcaggaggctgaggcaggagaatcgcttgaacctgggaggtggaggttgcaatgagctgagatcgtgccattgcactctacccagggtgacagagtgagactctgtctgaacaaacaaacagacaaaaagcccactagcatttattatttttttaatgtaaatgtggctgaacgcggtggttcacacctgtaatcccagcactttgggaggctgaggcaggtatcactgaggtcaggagttcgagaccagcctggccaacatggtgaaaccccgtctttactaaaaatacaaaaattggctgggtgcggtggtgcacacctgtaatcccaactactcgagaagctaaggcaggagaatcgcttgaacccgggaggcggaggttgcagtgagctgagattacaccactgctctccagcctgggcaacagatcgagactctgtctcaaaataaataaataaataaataaataattctgtcacatgctgtgacatggatgaaccttgaggacattaggctaagtgaaagaagccagtcacaaaaggacaaatattgtatgattccacttatatgaggtaactagagtagtcaaattcatagagacagaaagtagattaggagttccaggggttgggggtggaggagtgggagttattgcttataatgtataatatattttatattgtaaaatatacaaaataaataaaacgaatttgtgttttgttttgttttgagtcagagtctcgctctgtctcccaggtgagagtacagtgatgcaatcttggctcactgcaacctctgcctcccagattcaagggattttcgagcctctgcctcctaagtagctgggaccacaggcgcaagccaccaagcctggctgattttcatattttactagagacggggtttcaccacgttggtaaggctggtctcaaactcctgaccttaagtgatctgcccacttcagcctcccaaagtgctaggattacaggtgtgagccaccatgactggccacgttttttttgttttttttttttgtttgtttttttttgagatggagtttagctctgttgcccaagctggagtgcagtggtgcgatctccgctcactgcaagctccgcctccggggttcacgccattctcctgcctcagcctcccgagtagctgggactacaggcgcccgccaccacgcccggctaatttttttgcatttttagtagagagggggtttcaccgtgttagccaggatggtctcgatcgcctgaccttgtgatccacccgcctcggcctcccaaagtgctgggattacaggcatgagccaccgcgcctggcctgttgtttttgtttttaatcacacacgcacaccttctctacccccacaaaaaataactgcagttttctcaagacatgaatgttcatagcaacaccacatatatatgtcattaccaagctggaaatagctcacacccaatgtccatctgaagtagaatggacacctaaattatgctgtttcagccaatggaatactacacaggaatgaaagagcaaatattacatcttctcacagaagatggatgatgcttataagcataatgtgcaacaaaggaagaggacctatatgattgctttttaaattttatttttttgagacagggtattgctctgttgcccaggctagagtgccctggctcggtcatagctcactgcagccttgaattcctgggctcaagcaatcctcccgcctcagtctcttcagtagcaagactataggcatgaaccgctactcccacctacattttaaatttttttgtagagacggggtttctctatgttacccaggttggtcttgaactcctgggctcacctcccctcccctcccctcctttcttgacagggtctcactgttgcccaggctggagtacactggcatatcactgcagcctcaatctcctggtctcaagtggtcctcccacctcgggctcctaagtagctggaacttcaggcactcaccatcaagcctggctaatttttgtattatttgtagagatagagtctcaatatgttgcccagggtggtcctgaattctgggacccaagttatcctcccaccttggcctcccaaaatgttgggattacaggtatgagctaccatgcctgacctcagaattttttcatcttgcaaacctgtaactctatacactcactccccagtttccctttcgcccagtccctggcagtcactattcctttttttttttttttttttgagacggatggagtctcgctccgttgcccaggctggagtgcagtggcgcgatctcggctcactgcaagctccgcctcccgggttcacgccattctcctgcctcagcctcccgagtagctgggactccaggcacccgccaccacacccggctaatttgtttgtatttttggtagagacagggtttcaccgtgttagccaggatggtctcgatcccctgacctcgcgatctgcccgtctcggcctcccaaagtgctgggattacaggcgtgagcaccgcgcccggcctggcagtcactattctaccttgtttctatgaatttgactactctaggtacctcatataagtcgaatcatacggtacttgtccttttgtaactggcttattttttattttgagacagagtcttgctctgttgtccaggctgaagtgcagtggcacaattattataactggctgcagaatcgacctcctggactcaagtgatactcccacctcagcctctcaagtagctgaaactacaggtgctcacctggctaattttttttttttttttttttttttttttgaaacagggtttcgctctgtcgcccaagctagagtgcaggggcgccatctcggctcactacaagctccgccgcccgggttcacgccattcttctgcctcagcctcccgagtagctgggactacaggcgcccgccaccacgcccggctaattttttgtatttttagtagagacggggtttcaccatgttagccaggttggtctcgatctcctgacctcgtgatcctcctgcctcggcctcccaaagtgctgggattacaggcgtgagccaccacacctggcctttttttttttttttttgagacagagtacttactctgttgcccaggctggagcgcagtggcatgatctcggctcactgcaacctctgcctcccaggctcaagcaattctcatgcctcagccacctgagtagctgggactacaggtgtaaaccactgcacctggggctggctgattttaattagtataatatcctaaaatttctttctttctttctttctttctttctttctttctttctttctttctgtctgtctgtctgtctttctttctttctgtctgtctttctttctttctttctgtctttctttctttctttctctttctttctttccttctcttctcttctctccttccttccttcctttctttctttccttccttcctttctctttctttcgacattctctctctatcgcccaggctggagtgcagtggcactgtcttggatcactgcaacccccacctccccggttcaagcaattcttgtgcctcagcctcccgagtagctgggattacaggtgcccgccaccacacctggctaatttttgtatttttcgaggtttcaccatgttggccaggctgatctcaaactcctgacctcaagtgatctgcccacctcagcctcccaaagtgctgggattacaggtgtgagccaccgtgcttggcatatcctaaagtttcatccatgttgtagcacgtgtccgaatttctttttttcttttttttgtatttttagtagagacggggtttccccgcattagccaggatggtctcaatctcctgacctcatgatccgcccgcctcagcctcccaaagtgctgggattacaggcttgagccaccgcacccggccaacgtgtcagtatttctttcctagcctgggcaacactgtgaaaccctgtctctccaaaaaatacaaaaattagctggctatggtggtgcatccctgtagtccctcctacttgggaggctgaggtgggaggtcaattgagcctgggcggtgaagtctgcagtgagctgtgagtatgtcagtgcactccagactgggtgacagagcgagactgtctcaaaaaaaattttttttttcctttttaaggctgaatgctattccattgtatgaatggaccacattttttttttcccaattgcagatgtcaggctgaaagaatggaccacattttaggctgggcacgatggctcatgcctgtaatcccagcactttgggaggccgaggcaggcggattacaaggtcaggagttcgagaacagcctgtggtgaaacgctgtctctactaaaaagacaaaaattagccgagcgtggtggtgcgtgcctgtaatcccagctactcaggaggctgaggcaggagaatcgcctgaacccaggaggtggaggttgcagtgagccaagatagcgccactgcactctagcctgtgtgacagagtgagacttcgtctcgaaaaaaaagaaaaaaaaagcggccaggcacggtggctcacgcctgtaatcccagcactttgggaggccgagacaggcagatc

SEQ ID NO: 1543 - DNA, 55795 bp, Homo sapiens
  Genbank Accession No. AF000573
  unsure (1)..(55795): n = a or c or g or t
gggccctgtcctaaggcacatgcatgtttcaaactctgtgtcatgtttgctactagccaaagaaaaagaccctacctcttgatgggaggaacagcaaagtcacattcaaaggggcacacatacaaggataggaggaattggagcattttttgccatctaccacagggtggtttctctgtctctctcactctaattaccaatggttaaaaattggagcttcatcttatcttgaaaaatcagctagcctactttattcacttacacttcctccctcatctgttggcatttgagttgtgataatgcctaatttacaagattgtttttgtgaagttagatatggaaaaatttgacaaaagcagaaactcaatatatgttttctcctttctgaacaccactagtcatgaagctgctacctgccaatgaccaaggagagcggccaagatgaagaacaagggagtcatagaggaggtggctggagaataatcccttggtctgttttagaagtatagaggcattaggaaacaaaactcttaaagaatttataagaaaactaaacgtactttaagaaattaaaaggagcagtaggaaacatatcagtttgctctaagtgaaatatctcaggctctgaatggttcacccaagaacctgagctcattcctgggaggcacctgcagaaaactggttctggtcctggtccctgtcttcaggtggctgtgtgtaaacatcttaccccagtgtacacatctgcagctggtaaatgcctgggggttttctcactgctctccaggagaatcagcactgccctgttccttcctagcctgagtcaggactgagcagagaatcctccaccacacacagcaggcactatctgccacagttcctttccccgatagcttcaaattttctgccttttgaaataagcctacttttaactggaataaataattggtcaattttcacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaaggtaagaaaccatctgacaagtttgctatggcttcttcagccaaaatttatggaagtttctgagaacttcagggtatcagagttggaaaagacttagagaggccctggttcaaacccctgtgttcagaggcttccctgtggtgtctgtgggcacagctggagctgaagaacaagggaaaggtgataaaggaaagaaatgaagctcttattggtcatcccttgcctttgttcatttcaattattgtcttggaaatctgtagacatcctaagagctcccctccactacggacatgcacgtttctctctatgtctttttcccaacccctgctctgacaccttcccattgctgcagcctcatggaccacttccggtgaccagttagatatgcttgatctatttagttaattaaggctctgaatcagcccttggccagaagaagcacctcctctaggaaatcattccttctttttagtaataccaattgaaaagtatgtgtgggttatgtgctgttaggtgctaagcattttaactatgaattaactcataatcctcaaaataaatctggggtatagagagaggttcttgtttcaattagaaaagtaatgcttggagaaactatgatttgcccaaggtcactgccaatagatgacttgattagaagcagggtatgtttgaatgcgaagtccaggctcaaaaaggggccttagtggctcctactaaactggtatcttaaggcaaggaaaacagaatatgtccctaatatctaaaaccatgcctagtgcccaggccaggcttgaatcaatgctcaatgcatgcatgtgtaantgaacagaactgcccagaaccttggctcaggccaagtaggccagaccaccccacaacagacatcttccctgaatgcagggtttgagaagtgccctaatgccctctaactgatgctgagtttgaagaatccatcagttaaggggaggtgtttctgagtttgaagaatcaaacaccttcctaattggtaggaatcctgaaaacactccacaccggagtaaaagactttggttttttatctttatgcctgactaaaagttaactctcattctttcattcagcaaatattttgtgctagtgcatgacactgcagattaatatcgtagatgaactgagtctgggctaggtagagtcaaaaaaaaatttcctaaaggagcctgtacctaaactgagtcttcagagagaagttggaactggcaaagtgaggaaggacggggtctggagggaagagtgagtgcaaaggcacagcacatacagaatgcctgcatgctctagaatccaaaactgtgtcagccaaatttgagttgatggagggacagccaaactgagatacccaggcggtggttggatttatggatctggatttcaggggagtgggcagggctaggggaataaaactgagggtcatgatgtcagtggtaggagttgaagtcttggaagaaagagtagatagaaactttgttttctgatgaacattctatgaagaagttcagcagaagttggaaacatctttaccatttataaataaattttatgtaaatcctatcctgctgtcatgtttaagcaacttattatgcccagcaccaggacatcaatgttaattgcatgccagtctttgctctcagtttcaaaggcattcttccctgcctgctgtctaatctttacaaagaaaggttaactccagaggtcaggaatctgaacacagaaaaccagattgcatcatattcattctaatcaataaacattatataatttttaaaactgtttctcatcttttatttcttcattttaatgaatatgtcaacacaaagccgtaaatgaaatcacatttacacaaaagtacaactggggtaagaaaattcaaaagataaagtaataaaattaaatttaaaatgaaataccctatgtatttgagtaagttgcttagcttctcccaaccttggtttcctcatttctaaaacgaagaacttgcttaatattcaggctctgggccccaccaccaaatccttgattcactggctctgggtctgtatgtaacaagcttctggagtgattctaatgattagccagagacaggacctaccattctacgtaactgatttcctcttgctgctgtaaaaaattaccacaaatttattggcttaaaacaacacaaatgtattatcttgaagttgtggaggtcagaagtctgaaatcggtttcactgggctaaagtcgaggtgtcagtgtggctgtttcttctggagactctatgagagattgtgttttcctgccttttccatggattctgtttcctcttctagaggctacccacattccttggtttgtagcctcttcctcgatcttcaaaaaaatgtatctctgcttttgtaatcacgtcacattttctcctcttataagtcaaatctccctttgcctccctcttataatgacacttgtgattacatttaggatacacccaaataattaggatatctccccatcccaagatccttaattatatatgcaaaagtctgtttggctagaaaaggtaatactcacaggtttcaggggttaagccatacatatctttcagagtgagccattagccattattcagcctactgcgataatgtgcaagttccctttacaatctatgttctatgttcccatcaaggttaattagaaatattagactctttttccacagaaaaaaaaaatgtagcagtagtttcatctctaccctgacttctctctctttccttcatgcccagtaagagaagtgaggtgcaccatctgttcatctcatcaggtgttacctagaatcagagtcaggagaaagcacctcataaaactactctgacaagtaaaccatatcctgggggaccaagtganaattaaaaagctgtatactcataagctgccaaagagctgatggtactgaagtcacatggagctcaggaatttattcttgcatttagaaagtatgcatataattctctcgaaaagaaatgaaatcatatttttctgtcggatcaaattattcagaaatccgaactgtagaaaacatacaaacacacttgcttaatgttagctttttaatcttatttttgtacacagtatacttttacataggcactgaaccagctggagatgaatgcttggattttcacagctgataaaagcagagttcagattctgtccttgagctcaatgtctggagaaagcagctgtgaatactgcttccttaattcagatgcctttggccgtgaggggcatggcattttaaagctgcaataaactctgtactttttctctcaggggattagaaaaaccaattgatttgatagtgactcagcagttttcaccttcctctttagccaatgccctgcagctaagattgagaaacggattcagaactcacacctcttggtgcttggtggctcccttccaaaccatcagctgttctttctactttctttcctattttttaaagcacagtatactttaacataggcactgaaccagctggagatgaatgcttggattttcacagctgataaaagcagagttcagattctgtccttgagctcaatgtttggagaaagcagctgtgaatactgcttccttaattcagatgcctttggccgtgaggggcatggcattttaaagctgcaataaantntgtactttttctctcaggggattagaaaaaccaattgatttgatagtgactcagcagttttcaccttcctctttagccaatgccctgcagctaagattgagaaacggattcagaactcacacctcttggtgcttggtggctcccttccaaaccatcagctgttctttctactttctttcctattttttaaagcacagtntgaatcaagtgcttcagaaccatttatactaactcgtgttccaaacacataaccctgaaccctcttctaaggccaccagttacaaagaatggggaaggttaatgagtaactccaccagtgcctgccagaaagctcagctgtactccagccttccttccttttttgcagagagaaacaatggcggcagttgaacaaacggaaggcactgtaatgcccagtggcttcagttcacagggtggttctaaaattccattttcacagaattgaagataatttggggttattaccaattctcagcagctcaaattcaatcccgttgatggtgagcagggggttcattttgagagtagaaaattggatgcagtggagaatcagaatgttggatggtctctgccatttccccaaagatatcatcctaactgcatgctgctgcttttaacaaatcaggatacaacttagtattttttgtgttgacaaattttcaaatatacaaaatattgagtctgaaggcaaaaagaataatttttcacttccattgcttcctaggtcataacattcacatctgatatttcttccaaatacagactgttgttggcctgatcatcactcacacatccaggcttgttacatctccacgccactgagtatcagggaacctgccccaatattcacgtaggttcttttctattttccctaagcgtcggccaactttagaaataaagggacagagtacaaaagagagaaattttaaagccgggcatccgggggangcatcacatttcggtaggttccgtgatgccccacaagccacaaaaaccagcaagtttgtattagggattttcaaatggggaggcagtgtgcaaataggtgtgggtcacagacatcaagtactttacaaggtaatagaatatcacaaggcaagtggaggcagggtgagatcacaggaccccaggaccgaggcgaaattaaaattgctaatgaagtttcgggcaccattgtcattgataacatcttatcaggagacagggtttttaggatcaactggtctgaccaaaatttattaggcgggaatttcctcttcctaataagcctgggagcgctgtgggagactggggtctatttcacccctgcagtctcgaccataagagacaggcgcacctggaggggggctgtttataagcctatacctcctggntcgtattctctttctcagggatgttccatgctgagaaaaagaattcagcgatatttctcccatttgcttttgaaagaagagaaatatggctctgttctgcctggctcaccagcagtcagagtttaaggttatctctcttattccctgaacaattgctgttatcctgttcttttttcaaggtgtccacatttcatgttgctcaaacacacatgctgtacaatttgtgcagttaatgcaattattacagggtcctgaggcaatatacatcctcctcagctgacaggattaagagattaaagtaaagacaggcataaatcacaaggatattgactggggaagtgataagtgtccatgaaatctttacaatttatgtttagagattgcagtaaagacaggcataagaaattacaaaagtattaatttggggaactaataaatgtccatgaaatcttcacaatccacgaacttctgccatagcttcagctgatccctccgtttggagtcccagacttcccgcaacaactgaaaactctgggaaggcctacccttcacccacttccacccttcttatatctcttaaggagctgtgttcagatggttacatttcgctcgctgagcaagactgcattttcattatcctgggctaaaatcaattggtatttaagttagagcaaaaagggttctaaccttatttacagcagcacacatacacttacattagaattggctttaagggaaaaattcaatcaatcgacaaatttccactgattaccttttatgagccaagactgccatagtctcagccttcatgcagcttataggctagcaaaaaagccagacagtgcacaagaactcacaagtgtgttgagtgttgcaagagtaagtttcaggggctctccatgacttacctggttgagaaaccctttaactttttttttttctgggtgtaaagtgaagagatggcaatcagagtaggttccattgtgtcattgtgaaaagatgctgggctggcgtgtctcctgaaggccacccatatntttaaactttattttcatgcattcgcacaaatatagatgtgttccatagatgaggcagatagcagaggctttntgcctacagcaaggctagtttggagagggttttgctgtcagggttggacccacacaccttttcatagatgcttttttttttttttcccagagtttgaaagggaaatggagtttcaagttcagggaggttacagtgtagacccacaaatcagctaagtacagctaagggtggagnagtttatgcaatatccagcactcttctgattaattagaagtctttaaaattcaccagaaaccatattgtcttccctaaatgattctatatgtcaagacacagtaaagatattatatgtggaacatcatacacaaacataggtccatatagaaattcttaccttagtaaactgccaattttctgaaatgctctttaaatcctgctaatggtggcatttgtgtctttgtcacctacagtacatttctggatttgggaatgagtgttcttcagaggatcctcgctgcccaggttccctgccagaaggacaggtatgagcaaataaagtgcttagaagagctctgattcctatttcctggatgactagctttcaggccaaagtgcctccacccaccgtggttcttccaatctagcctgtgaactgtctagaggtttcccaagtcataggggcaatgaagatacagagcaatgacaacacaaagattaaaattggattggtggcacagcagccaatccaaactagtaaaattaactgtagggtttccagtaggatccccaaaaatccagggttaaagagaatccctcatattccccttgaacaccatggatgtgagcattatgataaaataacaaggtgctttcacatgtatgcacaaagatgttcatactagtgctggttagaaaagcaacaacacgggaaacaaaaatattttcaaaactttttgcaggccgtatcatagcataaaaaaatcctcatttcttaaaaaaaaaaggaaaaaatgcctgattattacagggttacaggtatgatagggtcacaattttggaggataagaatgcaaggaaaaataccaacatgtgaatgcttggttatttctggttgtgagataatgggtgatatcatatagtttatacattttctacaataaatatatattacttttataatcggggggncaagtcacatcaaaagttgttacaagaaacatatcgggttgccagatggtcatgtgcagtcgcccagagcatccccatccccctactgagttggttggtgggaaggtgggatgcttttcggatgggagtaatattgtttattgcatcctttgtttcagaataatcctcaggtctgcccctacaatctctatgctgagcagctctcaggatcggctttcacttgtccacggagcaccaataagagaaggtacaaggattagatgaattctgacctgcagactgtgggtactatgacagggactttgtgctgcctccttccccctgggccacagcctcccagagctgcccaagatcctgcttcttataggctatggtctgggtcatggtcagaagagaatgaacttcctgccagctagcaccaagtgactggtggaagaaggtgaaggaaagctgcacagagctgggaaaatacacatgtccagttccatttacaaattacctcctatattcagaaggaaatattcctaatagtttggtcttcttctaaagactgtcctgttgagttttggcttggggtttacctgttttgttttgtttttataatgactaagtcacaattatggaagattcagagcaatatctttctcagctgactagaggtatgttctttgcaagaaaatgttgggtaaacgaagtttggatagttaaaaantcacatattatggcccactgtggtttgaattaataaggtttttactctggtattcgctttgctagaaaccagcatattcatttacatactgtgccatgttccatgtttgctctaatcntacatccaggtcaatgaacgtaatcccttgattaactcatatcaggcaggttggatgcagtatgtgttatagttttgggaggcagtaagtgttatgatttaaacaaatagtgtctaattataaaaattttaggctgaggtatttgtgaagaggaatgctgctggtattagagactcggggagaagggcatgtggtcttgtactgcttagtagggcagcctgggtttatctccacaggtccttctgagaagcaaatgagatagtaagtaaaaaactataatggaccacacaaatgataaagattgcaaggtttaatcatggccaccctggaggcaggccccctaagtataaatcctggctccttttccagctgtgtggccttgggtaaatcatctgccctcttggatcctctagttcttcattcgtaaaacaaagataattatggtacctatttcatagctgtggtgaggattaaaagaaaggatgtgtgtaaagcacattagcttagcttagcacattggcacaggcacatggttagtgctcagttaatgctagttattgtcatgataactatcattaagtattgccatcatagcagagtttctgcctcatttccagggtatctctaggaggctgtcaagagaactgggcatgatatgtggcaagtgctatgttacaatgtcagtatcaacagtacttttctctcaatagatatatgcgtgggaagaggaagagatagagaaagatttctatacatgtcaaaaatcaggggataattccttcactatttaatcatctctctctctctctctgtaagcccaaatagggtaagataagcacgcagataattctgtccattctaatttatgacaacctgtcctctatgactatgttcttgactttatggcccattccctaacaggccacctggtctccggattctgcagcctgtccccattattcancaatatcttcagccagcaggagctgagctttgttccagcaggctgaaaaggagctgttggcatttcattaagaagctggcactgttccctgaatcagaattaaatctctgttcagggcaatgtagtactgcctggggagttttataaactcagctaaaaaataagggacactaggtatggctcacccatctatttagaagaactctccaaagatatccacaagaattttgtggaaatgcttcccacccaaaatctccagtgggaaaatgggaccagtcttatccataagtaggccagcctgaaattcttagttactactcatctgaaccatagcatacagggccaccacaaaactattaaagagtctatctacctacctacgtacctacctacctacctatcagggattaatttttatcagattagctagctgattgatcccttgggtcttgaaaaggcaaaagtctggagagataatttggaaaatgtggactgtgataaaaattcagaagattaagagaagaaaggcaatttaacaaacacatgataagccagcagctactgtatgccaggcatttttggtacacaaactctctgagttctcacaacaatcttaggtgacaaggatgaagaacataaggttcaggaagtctagtaactctcccaggatcacacaggtggttccaagacatacacacatgctctgaacttcatatactggganctggagaagcttagtaagaccaaggtctgaagtcncgtcctcnagaaatggagaaatcaaatggaaactaaacagatctagccctttttcccccagatggctcaatgttgggccaggccaactcaactcactgaggtaaactgtccttggtcttgaaagggccaaagcctgttgattcaggtctggtcttccgttgtccttctgtattttgtcagggcagtaccctctgaaaggacttgggtccctcttagtgancttcaatgtcccttccagcttctggaaggtcttatcctggtgtcctttcaaattcctttatcaaagtcttcttcccttcctgaagcctgaaatctggtcctggtagagaggacaccctttaaaaagaaaagaaagaaagacaaattaaggcataaatgtactacaataaaacatggacatacactcttataattttagagtacagaagtgttaatttatttttattttattttaagttccagggtataggtgcaggatgcacaggtttgttacataggtaaatgtntgccatggtggtttgctgcacttatcaacctatcacctaagtattaagcccagcatacattagccatttttttaatgctctccctcccccaatcccaccccccaacaggccccagtgtgtgttantcccctcactgtgtccaagtgttctcattgttcagctcccaattatgagtgagacaagcagtgtttggttttctgttcctgctttagttcgctgagaataattggcttccagttccatccatgtccctgcaaaggtcaagatttcattcctttttatggctgcatagtattccatggggtatatgtaccanattttctttatccagtttatcattgatgggcatttgggttgattttatgttcttgcattgtgaatagtgctgcaataaaaaaaagtgtgcatgtattttcataacagattgatttatattcctttgggtatacacccagtaatgggattgctgggtcaaatggtatttctcattgtaggtttttgaggaatcaccacactgccttccacaatggttgaaataatttacattcccaccaacagtgtaaaggcatttttatttttccacagcctttccagaatttttttttcttataaattaatatcaaaaagacaaacccaatagaaaatgataaaggatttttaacaagtaattcaacagaaaaactataaagagccaataaacaaatagacttgttttttggaaatattttgtattttctaattcataataaaggaaatacaaaataaaatgagatactatttttcacctaaaacactaaaatttttaataatactccagatttgtgaagatgtgggtgaccaggcactctcacacgttgttagtatgataataaagagttaaaatgatctgataattttgtttagaaatgcactggacgtatctgaaagaatatataagaaatatataagaaaatcactaagctctgatgctctgaggaatagccctgaagaaactggaggacgaaggtgccatttacctttcaggactttttaattacttgaattatttttacctttggcatgtattacttttgtaattttaaaggagaaaattgatttactatttcaaaaataacaaagataccacccatattctctcaagctgcgtagaactcattgttcttgccttccagagcaaggactagcatcctatgatacacacataagctaatgtttttctatggattttcctacacagatatccctcaaggtacttccccttcccttatagtttttagaaaagacaattcttcattttttggcagcatggaaataaccatgagtcagagtccatttgaagcatgatgggtggaatgaaaaagtgagaagaggccagggctgtgggcagcagatggccatgaaaagtgatgctgtatcattgcttcactgcttcacacattagagcctacaggtcgttgttgacttgagtgtcttcctgatggtactgcctgagccattctgtgtatcactcagaacattactctaaggcttgtatatcttgtatgtttttccctctagctggctgtataggattctaccttcagtttctcacaagccctttgaatccattgacgaaggccatgtcactcacaactgggatgaagttgatcctgatcctaaccaggtaacctggtcctgtgaattgaagcttatcatatacccaaagccttgactagaaatacctaaatagaataccatggtcattggaaaaaataaatagttttttaaagtattattttaataaatgctaaagtgtgtctgttttctgctcaaacttgggtggtgtattagtccattctcatgctgctatgaaaaaataaccaaaactgggtaatttataaaggacatatttttaattgactcacagttctgcatggctgaggaggcctcaagaaacttacaatcatggcggaaagggaagcaaacacatccttcttcatatggcggcaggagagagaagtgttaagtgaaagggggaaaatccccttataaaactatcatatcttgtgagaactcactatcatgagggtaaccatccccatgattcaattacctcccaccatgaatgtccctcccacaaacgtgaggattatgggaactataattcaagatgagatttgggtgagacacagacaaatgatatgaggtgggaattttggaaatgatggattgattatgtatatacatattgttaaaagaaaaacctttgacaaatctaatttaacagagtttaattgggcaaaggacaattcaccaattattctacctgtagccaggataggttctgagagattccagtgcagacactagtagaagacgatttatggacagaaaaaggaaagtgatgtngagaaaacagaaatgaggtacagaaatagccagattggttgcagctcggcatatgacttacttgaacacagttttaatagtgtgtcaccatgattggcacaagagtaggttacacatccaattaggttatggttcactatgtatggagaaacctttaggcagaacttaaaatntgtgaggaggcaactttaggacaaacttgattaacaatctgcgtgtgtgtgtgtgtgtgtgtgtgtgtgtgtgtgtgtgtgtgcacagcgacacataagcttgtatttctctnccctaanggcatataganngacacnagagtagnncngacttactaaaacngcncnggtgaatnggatgagcggaaattttatgggtgggtcaaaatattttatattttatnggtgggtcaaaatatctacacgctcaggggttttttttgtttttaatctaaacttaccacaaaatatagaaaatacatttaatacagacatctttgaagnnaggcctttgaaatctggcataggggtgagagtcttgctatctgggctgaattatgcaagtctattgtggtcacagatcactatcacagtctcttcagacctaggacttccattctttttctaggagtttcctccttttggtctantaatagtgggcgttttctctaattatcgttattacttacgtactctgcttgcagagtatataagataaaatgagacagaaccagtactatagcaatgagatagacccagtgctataaacgactgagctctttttttaaccttctgaaaaccccagtgtattgcctttgtccctgaatttaagtacatgttgctgataataggtatgtagggcaggaagaaaaacagacctgggtttgcatccctgcccatctacttactagctgtgtcttaagctatgatgtttcaattgtaaaatgggatgataacatttgcctcacagtgctattgtgaagattatgagagaataggtgtgaacctgcttcatacaatgcctggcatgtgataggcaaaaaccatgattctgatacagctatttatatttacctgaatttacattattcaggtaactttatttcttcattttatattattttttactctgaaggcttcttctgccctctttccctccctcctactctctctctcctccctctctccccaccccgccactttccacaacccaaggaaatctcctgcttcccctttgtttgccatgacattttgtctatacctgccaatctccctcccctaagtgcttaaactttttataaaacaaaagtcaaaataatttataaacacctttggtttcctgcccagatctctctcttgtcttaattatggaaatctcagcgaaataagcatctgcttgaatgttaccaccctctctaccagggacaggaagggagggaggcatttagggtggaaaaatgtgaattggtatttaaaatactatctacctcatagccactttgaaactaagatattttgtttaaataattgacccttaaacttgtatgaagtttaatgcataaagcagacatctccctggtccccagctggcctatatattgcctttaagcacattgcaaaatgcagcccctattttaacccccaaccccttagactcagtcccccacacaaagggacacagacgaggcattccgctcctccctttccccttcagtgggacaaggcccttgcacagggcacagcttgcacaaccaacctggggaccctgacttcacctcattcctgagtttcatgtggattcaagtaatatgggtatagtaattatgtatatgaagttaactaaatgagggattataagaaaagtccatgggcagatttggataaatttaaattattgtttatttataatgaaaaataattatttattattattttgnttcaagatagcaatcaaatcagtagtggttaacagggtaggctggggagttccagggctcctgcctgctcatgtcgatcacaacaattttctaagcctctcaaccttaataaatcttcatagatctgtttatagttgtgtggacaacagtggagccatacttcttttacatagttttattcggggtgggaggttaggttttaaacctaacctttaaagaaaatatgtgatgtggctntactttgagtgtgatgtgtaatatgctcagtaatatacctttattatatattattatttccttgactatcattgctacattttatttaacatgaatacaccctttcataggaactattttggagttcgtgtgacatatccatggaagacaatcttgttctaatagaatttttctagctttgtcttttttttttttttttttgagacaagagtctcaccctgttgctcaggcgggagtacagtggtgtgatcacagctcactgcagccttgacttcccaggctcagatgatcctcctacctcagtcccctgagtagctgggaatacaggtgtgcaccacaatggccagctaattttttgtatttttggtagagaaagggttttaccatattgctccaggctggtctcgaactgcaagggctcaagcaatgtgcctgccngagcctcccaaagtgctggaattacaggcatgcaccactgcacccagcttagcttggtctgattgtatgagtaaaatatacttataaaaacccaaaagtattgtagaaattaataaaatattactggacgtctcccatcattaagtgagagtcaagtatataagttgtacatgttaattcattatttcataaatagttgacatacattttgaccaggaagtttgaagcaactggattaaaaagcttgagttaatacagaggcatcaaaatagctgtatcagggtgggcatggtggttaagcctgtaatcccagaaattggggaggccaaggcaggcagagacctgagactgggagtttgagaccagcctaacctgaggtcaggagattcgagacagcttgaccaacatggagaacaccatctctactaaaaatacaaaattagccaggtgtggtggtgcatgcttgaattcccaactactcgggaggctgaggcaggaaaattgcttgaacccaggaggcggaggttgtggtgagccaagattgcaccattggactacagcctgggcaacaagagcaaaactccatttcaaaataataatgacaataataataatagctgcattggaagtttttgcttgttttttagcagaccctcagcccatatttgttccccttctccccgcttcccatgtctcccattctaacctatggttagaatggctttgcttttgtccttgaacttgttgccttttttctgttttgaattccctgaacactttctatatggtagccaccaaatgaatttcttctccaatatcttccctgctcctttgagaccttgtcttcacacacactgggagagatgtgcctcagaattcaatagcgtctcagtgtctctgtgaacaccggctccaaccaggtagcagtttattatctttctgacttgtgacctctgtcacctgccaactacttctctctccatgataaaccctggctgatcttgcaaaatctacccttttgtcttttcttttacaccttctttacaagttaatatctctttccaattttatacttcattatttaaccacagcattttgcattcatcactttctccctcataacctcctccaaatatgtactccagactctcagcaagaaaggctgagaaaattatatttaggcaccctctgacagtccttcccagctgaagcctgtgtgataggtatgtcttcacctgtcatagaccaaatccaatacttcatcagcttcaccaactatccacattagtcatctctgggaatttgaagacctgaggactgcctgatgattcctccagtgtaacatttaatcccaaaggcagcatcttgcaatatgtgatcatcactgtcatccttgataccctctcaggaagactgggggctgctccccctaaagccttcattttctttagtgtatatttaatcagttatccaagaattaatgcaacctctttttgagtgtatttaaattcagcctgaggacataaattcaattaattaatacctcacataagaagtatacctaattttatgtgtctgcctctaatttctgaaatctcagaatttaatgaactaatctacatccagtttaaccatgattttacagatttcagctagaattcctgaattagcacttctctttaagagtcctttaaaatttatttttcttattatttcattctaacctcttgattgttgaaaaatcagattcttgactcagttaagactcagctganaaaattacctcttggttcttaaccagtataatttggatcaagtgagaaatacctcaaagctaattaaagaacatatcataaaatgccttctgtctctagtacatgcaaattataaaaaaaagtttcaaaacaatatacccttacagggtatttgctgtctaatttgtcaaactttccaggttttgccatcctgaaatccccttccctccacaaatgtcttggatttttctgcctctcttgcccaagtctgtcctagtcacagccagactccttgagaaataatctaaacccactttatcaccctcattcactctttaaccctatgcaattcagcctgcccagatgactctattgaaaatatttataccctctttacacaatantgcatcactctctaattaatacatatttttatttaaaacttacattaaagtgtcaatgcccagtaattccactaacacagagttaacaacttntaatgttttgggttctttccagtcctttctttttgaacatatatgtaaataaataattcctagggtcccatgtagccagtaaccaagagtaatttaaaataatatntggccaggcacagtggctcatgcctgtaatcccagcantttgggagnccaagatgagaggttcanttgagtccaggagtttgagaccagcctggcaacatagcaagacctggctctacacaaatgtgaaaaaaaattagctgagcatggtggcaagcaccggtagtcccaggcactcaggaggctgaggtgggaagactgctcgagcctgggaggtcagggctgtggtgagccctgttcatgccactgcactccagcctgggcaacagtgtgaaaccctatctcagaaaaaaaaaaaaaaaaaaaggaagaaaaaagaaagaaggaaagaaagaaagaaaagaaagagaaaagaaaagttaatctttacttgtttttcctgaagacattaaacagtatccaatatatgacccacagcaacactttttaaaatcccctttttccagtttttcccagactccaaccctctcacatctgtcttctctcacctcacctctcaccttccccaagctcttcatgccttgtcaccattgattgttggcttctctncttcctccctgtacattctgcctctagaaaatgatacctgcactgtagatcccctaccccatttggctgggatcacacatggtgttatgtgggataacacacacataacagtgacctccatggcaatactggagttcaaaggactccagtgagaataggcaaatctgaattttccgcagagatcagggaagggaagaggaagaggctatgaatacacttataatagtgcttttaaaaaaaaatcagttacatatatatttactataattaagctgatggtgtaatgcagtcttagattatttttatttaaatatcatattttgcgcctttttccatgtctttttaaacttcttgagtgtagatatttttgatattatattataatccaataaatgtttataaaacaattcctaatattgtgagatatttgaattttttccatttttgctattatgtngtaaatccacgctaaatataatccttttctcctctacatcccagcctggaacaacagacctccttcttttcttcctgaatccccttttttccctgggttccatgacattgcatgattcccaaacctgcaaaataagtattcttcaaggtcctgaactaaaatcttgatatagtttgactgtgtccccacccaaatctcatcttgaattcccacgtgttacgggagggacctggtgggaggtagtctatctgcacaagctctttctttgcctgctgccacccaaatganatgtgactttctcctccttgccttctgctatcattgtgaggctttcctagccacgtggaactgtaagtccaattaaacctttttcctttataaattactccttctcgggaatgtctttatcagcagcataaaaatggactaacacaactctcacctcccccttgtcatcatctcccctctgagagaaggggaagtacttactctctctcttcccctcctcttccttactgtctttcttatcctcctcttttcttctccttctcttcaccccaaccttccccttcccctctgtattgttctgctaaagctatcataacaaaaaaatactgggtggcttaagcaaaaaaaatttactttctaacagttctggattccaaaattgaggtatcggcagggttgctttcttctgaggcctctctcattgacttgtatcttctccttggctcctcacatcatcttccctctgtntctatagccaaatttcctcttcttataaggacaacaatcatatcanattagggtccactctagtaacctcatttaagtttaattattcctgtaaaaacccatctccaaatatagtcacattctgaaatacagggggttaggagttcaacatatgaatttggaggaggaacacaatctagcccataattctctccttctgcttctttttccctctaaatatctactaaggattcccaatcttttggattctctttgccttanagatgaagggatagttgttgataagaaataatcaagtgggacaaactaacaggaggaactccttgagcaatagaggattttcctagctcactacactgaatcaggtgccaagtccatagaatggtgatgcctgagtatacataagagttaccaggggacttgttgaaaatgtaaattcctcagtcttgctccccaaagatcccagttcagtaggtctgaggtggtactcaggagtctccccagatgactcccatgcaggttggtgctggactgcactttatgaaattctgctgtaaagtgtgctttcaggatctctctggttccttttttccttttcctacctccacctggttcagacctcatttcttcttacctagactatgttaatgaccttctacctgattcctatgtcttcccctccctatcccacaccgtgctgccagaatcagcgtgctaaattatcatctcaaaaatctttaaatttaaccatcacccgccccctccactgcccagccaatccagtgcaggcttccagataagagatcaagagctttgattcactatcacagcctttcagactctccactcacttccatgtcccctacctatcagtcacactagaaccatcgtcattttatctacctgggatttcctgttcttccatcacaaatactcacccatctaaatctcactcatgatttatgattcattttaaataatacttttttcattatgccctttcaatatttctcagagtatttaaggttctatgtctctatcatcttcatctgatctgcagtatccagtacatgccttcttccaaatagaatcgcaagtatttgttgaatttactccctgatagttcagatcctatcattctataaataaattagattgcatttctctaaatgcattcagtggtgtgtgccaacattacagtgcacattcccctgctcagcccttttggacagcttgctagctctttttacatttcatctccatcaacttacatttcacttcttgcaaagatattggagctgtctgcaaaccagatgatttcattgcttatatctcttattttccatatataagaatgttaaataggccctgtgccaggacttattcctgagagaacatttctatttacatttctcttccaaagttatttgcactgatccacttccttgtttttctatcatgaggttttcacatttccaggatcttctgtnatggattacctgagggaaaaaacaatgtcntgttcacctccagcatctagcataaaatctggcacacaganaggttcaataaatactgtttgaaataattaatataaggggattagacaagaaacnttaaccctgaaggacctaagcagggttngtgtcccaggaatcanactggccagggtgattcagcactggaggaacagtnaacaaaggtcaatttggaaaaccaggttcaagaccnttnaaaggagggaaagcttgggtttaggagccaaggagatcaggaataatttgggaaacaggtcaagacaggctaagatcaaagggctcagggtgtaggttagtaanagggtctgaaaaagtgttggcatcagttcttagtaaaaaaaatttaactgttctaaaccatcagttttttcacttctaaaatagagatgataataataatcatagggagcctcagagagttgttgtgagaattaaatgtcatccaacaaatatttattgagtgactattatgttctatacttcgtgctaggtgctaggtaatggatttaaagctcttagctttacattcaaggacaaggtcaaatgagaatccaagttttcatccttgatggctcatcttcatttgttgctcatgaaagacttttgttatgttttgttttgttttttgagtacaggctggagtacagtgttgtgatatcagctcactgcaatctctctcttgggttcaagcgattctcctgcctcagcctcccaagtagctgggattacaggtgcccaccaccatgcccggctaatttttgtatttttagtagagacatggtttcaccatgttggccaggctggtctcgaactcctcatctcaggtgatctggccgcctcgggctcccaaagtgctgggattacaggcgtgaaccacctcgcttggcctgaaagacttttagaaatctaaattacagtgacttggatcctcattatctatattcttgcctatcacctcaaagaactccaacggatcaaccaaagcctgatttctctccacataattcatgctacctttttttcctcaaacttccaaagtttctgaagaattcaagtgagccactgttttattttaatccttcctatctttcttagtctggactgaaactcaccaccacaaattaccctggatctctctgctaacaactatttatacattgtattagtccattcttgcactgctataaagaaattcctgagactgggtaacttacaaagaaaggaggctcatagttccacagggtgtacaggaagcatagtggcttctgcttctgggagggcctcaggatgcttccaatcatggtggaaggcaaagggggagcaaggtatctcagatggcagggagcagagcaagagagagaagaaggaagtgctacacgcttttaaagaccagatctcatgagaactcactgtcatgagaacagcaccaagaaggtaatgctaagccattcctgagaaatccacccccattatgcaaccaccccccccctcttgctcctgctcccatcatatgaaatgctcccatcatatctttgccttctgccatgaattgaaaactttctgaacctctccagaagcagaagctgctatgtttcctgtgcagcctgcagaactgtgagccaatcaaacctcttttctttataaattactcaatcttaggtctttgtttatagcagtgcaagaacgaactaacaaagaaaattggtaccaaggagtgggacattgctataaagataacctgaaaatgtggaagtgactttggaactggataactggcagaggttggaagagtgtggagggctcagaagacaggaagatgagggatagtttcaaacttcctagagacttgttaaattgttgtgacaaaaatgccaatagtgacatgaacaataaagtccaggctgaggagatctcaaatgaaaatgaggaacttactgggaactagatcaaaggtcaaacttgttctgccttagcaaagaacttgactgcattgtgttcctgccctagggatctgtggaattctgaacttgagaatgatgatttaaggtgtctggtacaagaaatttttaagcagcaaagcattcaacatgtgaccaggctgttctaaccgcttatgcccacatgcatgagcaaataaatgacctgaagttggaacttaaatttaaaaataagtttagatttaaacctatatttaaattttaacttgtatttaaagggaagtagagtgtaaaagttaggaaattttgcagcctggccatgtggtagaaaagaaaagcccattttcaggagaagaattcaaacaggctgcagaaatttgcataaataaaaaggagccaaatgctgatagccaagacaatgtgggaaaggcctcaaaggcatttcacaggcctttggggcagttcatcccatcacaggcccagaggcntaggagggaagaatgattttgtgggccaggcccagggccttgctaccctgcacagcctcaggacactgttttctgcatcccagctgctccagctcctcctgtggctcaaagggatccaagcaccgcttcaaagggtgcaagccataagccttggtagcttccatgtggtgttaagactgcaggtgcacaggatacaagagttaaggcctgggagcccccacctagattttagaggatgtatagaaaacttaaatgttcaggcagaagccagctgcaggggcggagtgctcacagagaacctctactagggcagtatggagggggaaatgtggggttggagctcccacacagatccccgctggggcattgcctagtggagctatgagaagaaggctaccgttctctagactccagaaaggtagatccatccacagattgcaccgtgcacctgaaaaagccacaggcactcaatggcagcccatgagagcagccgcaggtgctgaatcctgcaaagccacctgagtggggctgaccaagaccttggtagcccacccctcacaccagtgtaccctggatgtgggacattaggtcaaagagatttttttggagctttaaaatttaatgacttccctgctatgtttcaaacatgcatggggcctataaaccctttgtcctggccaatttctcccttttgaaatggaaatatttacctaatgtctatacccccattgtatcttggaagtaactaacttattttatnttttacaggctcataggtggaagggacttaacttgtctcagatganactttggacatttgagttaatactanaatgagttaanacttttgggcactgctgggaaggcatggttatattttgacatgtgagaaggacaggagatttggaaggagccaagggcagaataatatggtttggatctgtgtccctacccaaatttcatatcaaattataatccctaatgttggaggtggggcctggcaggaggtgataggatctgggggacagtttctcatgaatggtttagcaccatccctgttggtactgtcctcatgatggtgagtgagttctcatganatctggtcattgaaaagtgtgtggcacctcccacctctctctctctctttctttctctctctctttctctctctctctctctctcactcctgttcctgcaatgtaagccatgccttctcctgcttcaccttctgtcatgattgtacatttcttgacgctcctcagaaactgagcagatgccagcatcatgcttccctgtacagtctgaagaactgtgagccagttaaacttcttttctttataaatnacccagtatcaggtaattctttatagcaatgtgagaacagactaatatgnacactatgatgactatttcaccgagaaattacttcaaaattcttggataggtggtactgacttctaatganatgtctgtctatcctcagccagtgttgttgagagtactcaagtcatccaatctagttgagtccatgggaaatttggagggaatctcagtaaattaaagaatttcagttttgaaaggganacttggatcatctagttcaactcccagtattctaactggaaatatttaggccaattatctaatattttcttttcatctctgagcatgaattttgaatcttgataatcaaatgttgataccaattctgtcttcctcctttggtaatcttaagtaatttttaattctaactttggacacccttaaagatgctttcaaattatttttgaccacctcatttctagcaagtaaaagtttatcttccaatagactcatagaatacagttgtaaaatatgtgaagcaataatacaactaaaaggataaatagacaaatccacaattttagttggagacttcaacacccttctctcaacagttgatagaacaactgaacagaaagtcagaaaagatacagaagtgatctacagaaggagcaggattggaaaaaaagttttttaaaaaagaaaggatatggaagtgacgattttacacgtgtgaagaactgacattttacctttggacttttagaaatatttgattttctagacatcgcctgaatgttattttgacttccaaaagatctcacggtccaggcacagtggctcatgcctgtaatcccagcactttgggagggcgaggcaagtggatcacctgaggtcagaagttcgagaccagcctggccaacatggtgaaacctcatntntactaaaaatacaaaaactacccgggcatgggggcatgcacctgcagtcccagctactcaggaggctgaggcagtagaatcgcttgaacccaggaggtggaggttgcagtgagccaatatcgcgccactgcactccagcctgggtaacagagcgcgactccaaccccccccccaaaaaaaagatctcaaaaatttactttattcttgttcttagcaatgttgttagtgccttagatttattcatctattcagtcattcaacaaatattaatgcctactatagtcaagccattgcattgggcattacaattgattttattatttttgaaatgtttaataagtaaattctatagagaagaagctatttaacaatagcgtatagtataaataaaataaactatttttaaaagttgtaggactatattagtctgatcaagctgccataacaaaataccacagactgggtagtttaaacaacagaaatgtatcttcttacagttctgaaaactgagagtccaagtccgaggtgttagcagggttgatgtcttgtgaggctcctctttggtttaaagacagtccttcttactgtatcctcacatagcccgtcctctgagtgcaagcagagagagagatctcttcttcttataaggccatcaatcctatcagattagggccccacatttatgatctcttttaactttaaaacccatctctaaacatagtcacattgaaggttagggcttcaacacacaaatttggaagnggacacaatttagtgcatatcaaggactaaatcagtcagcaagcatcctttacttctttcagagtttctcctctggagagaattatggaattatagttctcaccagcacccattgttatatgtaagaaaaaaacaaaatttgggagagaaaatggctttcctgaagatcacagagtaaacgggaacagagacagtagcaaaaaccaagtcttcggtgcactctccttttggtctggccttggctcagagagttactgctccacagcatacaataaagctgcagctggctttagtagatgtttgtaccatgcactccatggactcttcctattaatcctctgctcaaatctccctcctcacacttatcaaaatatcacatcagcgctcctgaccaaaatctctgctttctcttgtgagtactgagtttatcagaaccaccttggggattttcttatccttcatgatacaggcccagtatgatctgaatatagactctgtataatcttctgccatcagggccaacagataaatgactcctctccctatactatctctgtcatttggtggggatcattttttgcattagagaaggttcgtcaaggtcgttgctncttccagattgtgggccctattgaaggtatttcctctccactataaaatgtatttgcatttcctcccaccacctcaggctctctgtcctcataacttgagggctaatttgctacaaaaaaccttgaaaattaaccagctaacctggtcaacccaccattctctctggctcaacctttcccacccaaaaaaaacaaaccccttctctaagggccaggactttattaccactcacagcaaggtttttgtttgtttgtttgttttgttgttgttgtttttgttgttttttgttttttaaacagagtctcactctgtcgcccaagctggagtgcaatggtgaggtcttggctcactgcaacctccacctcccaggttcaaaaaattcttctgcctcagcttcctgagtagctgggactacaggtgcatgccaccacacccagctaatttttgtatttttagtaaaaatggggtttcactatgttggccaggcttgtctcgaactcctgacctcatgatccaccccccttggaaaaaaaaggtgctggaattacaggcgtgagccaccgcccctggccttaccacaggtattttaacatcaggcagatgtacaaagatattgtcccagtacaacaaaccaggcagaaaaatcccctgctactgggatttctccctctctctcttctttctttccccttgctctttcttcttttttcttgatcactttctttgccaccgtatggcccaagatgccagaaaattagttgattgatcagttggtgggttggttggtttgttgactggatggacttttctgagtatgatgcttggttcatcaatacaagaatcacagaacctttggattgggtttttaaaccctagctgcacattagaagaacttttataaaataccgatgtttgggccctaccttcacagattttgatttaaattggtcttggtttcaaaggctttccatgtgattttcatgagtggccaggattgagaatttttggatagagctaaaagattacgcaggcaaccattgatttgaaaattaaatcccttttactgggaaatccagaaagaagactctttctggattttctttccgaaactaagattttaggtagtattgttttcctaagaattttcctgggtataaataatttgctttgttactatagaaggaagcagcaggtaatgtttagtggtagaccagaaattcccctaaaaaatccagcagtggttagctgtggcaattcctgaagttagggaaatatcctcccaggtcagtggttttcaaatgggagaaaatttcccccaagtgaagtttggcaaattttggagaaatttttggttgttacaggttggtggaatgtcaatggaacctggtggaggcaggccatggatgatgctaagcatcccacaatgcacagaacaccttcccacaacaaagaattattttgtgtaaactgtcaatagtgccaagattgagaaaccaattcctagatccttgccctcaggtccccctaataaacccctaagagataccatccttaatgaaattagtcctaaagcatttccttttttttggagcatgatttcagcaatgtttcccaaattaaaattttaaatcctttttaagtattttttaaagtgaccatcctgctttggttttaagaaaagaaggctgctgcctgactgtgtgtgtcagagaggcagaataatcccaaggctgccttttccaaatggtggttcctttcccatttggctgcctccctgaaaaacagaatgagatgagccctatgacctgatggaggccctgccaagcccaccttgaccaggtgctgcagccagtggagctagttttcagggtgcgggtcgctccatgaaaagtggcagctgggcttatcagctgccagcctggataagtcaggcctgctgccaagttgattaataagcgctgggctgacaattcaagaagggcctaaacctgctgattttcctccccttttccttagatcatttcattattaaattaaagattgttgtgatttaaattgaactgtcaggcagcttagggacaaacgtggggtttggtgaagcagctgaacctggtactgcatttaccaaatcagatttcagctgggtgtcttctttctcttaaaaaaacaatttagaantttaagggcttgaagtagaagtagaaccttcccctgcagtgtcaggagcccacacagggaggntggcatgccaggaaagggacctgattataaatagcatgaaaagcagcatcagtcaaaantcactgatgtgcctgggcaaaatgttaaaagaaacaaatagnttttaaaaatggaagcaatggttttatttttataatttaaagtgntaaggaacaaaagcagtttatattcacatagttttaaacacacaaacatgtgtgtgcacgtgcacaaataacacacactaacagagtccctttaaggaaatgatggataatcattttaatataacaaaatcacaagtagagcctcacagagggggtagctgtcctttntttttctatgtaattgatgctatttatttagaaggtctatggtttacccttgtgaagtaatttttctgtatgtgtattttttttccagcttagatggaaaccatttgagattccaaaagcatctcagaagaaagtagactttgtgagtgtaagtcagtcccatccacacccttcctactgctctcctctcttctgtggtgagtgagccaaccatttgcagcctgaatgccaagcaaaagcagccctatcaggaggcagcacacacaaaaccacctgcgtatgctttgggggctggcggagggatgtcttacttacagaaaccatatggcccctgacaccagagggtattcatgaactatttatatctcagaaaggccaatgacaattgaacattttcttacttgccttcctttcttttggctagaacgggggcttttaacctttttctcactttgatgtctgatgtctgatgatgtctttgtttataaatatataaaataaattatataaaattacaaagaagctaatgatattgaaatataacgataaaaatactattaaaaacaaatttgatttggtttatagtcattcatgtgctttcttgttaatgtgctaaatcataatatctatgggaaaacatctaataattctggtatgagcataaatatactttgaggtatctataacaactataatgtgatatccatgatttttatcattgataaagttacaggcacctctaatactgctgtggttttttgcctacattcatattagttgaaagaaatgataaatttcactcagagattagcaaaagtaaatataaaatatttcccatccaagttcataaatctccctgaagtagatgcttgggctagaatggcgtcaattcaacatggcaactctagttagtacaatgctgattggaagctctgtttggtagttataggtcccaggagtactggaataactgcacagagcaaggagtatctgggggagaggagaaaggagctctaaggaagtggggctcaaagagaccagtggagggttctgcagaccagcctcagctcatggcttacgtagggacactccaagtgccgagccataggataaattgttggaaacatcttgaagttctcatctttattaagtgctccaaactctttgtagactcacttaaatataccctaaacttacaaattgagttaaaatacaaaatgatatccccatctcctttcttgtgtgaattgtagatatctggaggcgcagagctctctccttttggctctccatctgcaggtttggggctgagggctattttgagaagacccatgtgttaaggtttcttgcactatggatcatctggtcacacagcaganagaattacagtccatctgaatacagtcctctgccctgttccaganagattaggctgaccctatccataagcagagggctgcccatagtggagtgtacttgagaggcattaactggtccctgatgctgcaaccttcctccccaagcctcctagatgcctgatggtacctccaacagaatctcttcttccagttgatgtcaagcatcaaattgataaaataccaagtaatgaactgatactctgtaagttcttctgatatagccactaagacaacccagatttaggccatggctggagactaaggtaaaccacaaactaccaaacatgagtcagtaaattcaggctccttagaggctgcctggattccaaacgtcccaccggtcccaaagggaagacctagtagaaatgtgcctcatgaacctcagggaacagtggaaaggctgcctcttgggcaccgttcacattaacctttccctcttctgtgggtctctcccagggcctgcataccttgtgtggagctggagacataaagtctaacaatgggcttgctatccacattttcctctgcaatacctccatggagaacaggtaagtggctcagttttagggaaggacatgcccatcttctaagggattttggccagaagtcaaactccaggtttcactcttgtgaagtcacatatgcacatacatagttgtttttgttattggttttctcctcaaggcaatattcatatatatttattgacaatgataatgaatgagacaaaaggcatttatcttgactgaacatcagtgatataaacaagcacatcacataacaatgtnaacagaaaagggaggatggagccctggaatgcaggagtagatcnaaaggcattttgactttaagtctgagtccaaatatgcttttgttgttgtttgatatttcaaggatttttctgagccaaatatgagtgaccaatggcctgcgacacagccatcaggagatcctgagaacatgtgcccaaggtgattgggctacagcttggttttatacattttagggaggcataagacatcagtcaacacatataaggtgtacattagatccaaactgtggtttttatctcagtagaaaagtaacagcagatttaaagcaggcagaaaagaaaacagagaaatagagaacttagaaactctgtagttgcaggttgacctttgggctctgaatgatacaattttcccattggtttaaaatgtgcacaacagactgtaatatgtaaccagctggagtactagaaactctggcatacccttgaacttttccattttacacaaacacttgcaagtagaggcacctttctccttgtctttcctcattcttagattatttgtttcccacgttttttttcttaaaaggaggaactgagctgtgacctaggggttttgtgggtggtggattggtgtactgaatgtaggcaggactccacagtgtttcaccaccgagtcgtttccaccctcttacctgtctcagtttctctctccagagatctagcacctctgagaggcctcaaaatgccaagtgatcagctcttatatgtatttccgggacaaaactatttttgggggggttccctgtagggccactgcacatcacaggggatgaatccctcagacactgcaactcagcccctagtcacccagggtgcctttcagttgggaagaacaaaatgccctttctcttcagagctgaaggagctcagtctctcatttatgcacaaaaatgacagtcacacgaatgcgcagcaaagccaactggagctaaaatttggggaggaaaaaccaatgggaggagaccaatttagaatacacctccaaacttggaaacccaaacaggtacccaaaaagggagtcattcttgttgtctttagaaaaagacaacggaggccgggcacaagtggatcacgcctgtaatcccagtactttgagaggccgaggtgggcggatcacgaggtcaggagctcgagaccagcctggccaacatagtgaaaccccatctctactaaaaaatacaaaaaattagccgggcgtggtggtgggcgcctgtaatcccagctactcaggaggctgaaaaaggagaattgcttgaacccgggaggcggaggttgcagtgaaccgagatcatgccattgcactccagcccggacaaccgtgtgagactccatctcaaaaaaaaaaaaaaaaaaagaaaaagaagaaaaagacaatggagaaatcctttagaatggacctgtgaactagaattaggaacctaaacaagagcttcctaggagggaaaaatcaagaactgtcaaccaaacagggctcaggaggacttaacagttccatcagagganaagcccaaagttgaaggcactttcaataggtccctgctgataccttagctctgagttcaggcaactccttcagggttctgagtcttctctgaggcccaatgtgtccaggtgccaaattattgttgacaaaaatagtcaaactattaatatgtaaaatatttgaattgatgtattctgagccaaatatgagtgaccagtgacccatgacccagccctcaggagatcctgagaacatgtgcctttgaatatccttaatttctaaggttccccagggctgttcttgagtcccaggtcacagtgtgtgagtttccattaggaccacccattagtagcaggtaacccgactttggttcagctaacagctctgtgtaagcttaaaatttttaagtagaggagcttatatactggctttgcaaaacaaagtatgcaaatggcattcctgccttattatacactacctctggaactggaccatttgtgtccaaagcccaactttacatttcctggctgagcgaccttgtgagccatgaatcagggacaagatcacagccctatgacaaggctctggaggcctctctttgggtcaaatctcatatcaggccactccctctctccacttgagccgcattggccttcattcacttctttcaagctgccgcgtgccctctttaagcacttgcacttgctgttccttctgcctggaacattctttcctttctccaaaccctcacctagataacaccttcagatatcaggtcaaatgtgtccnttctttgaagaaccttttgctgattcttcaaactaaccaagtcgctattctttcattccctcaaacttgattttcacagggtcattacagtctgcaaagatattgttctgtaattatttgattgctctctgactccccactagactctaagttccacaagggcagagcctgggtcattttgctccccattttatacccagctctgagcttgcnacataggcactaaacaatgatttgtgttatgacgtaatttgtctagacaatgttaaaactgaaaatcacaagaattactgtatatgtttcagatgcttttacaattcagatggggacttcttgattggtgagttctgaagacttcagaccccctcactgataattgacccctaaccgcaagctgctttctaattttatacacattattttccttcattcttcaatctgtcttatttcatttagtgcaatccagagactgaggtctagaggccacaggtggtctggaaaggttctagtgtcctcaacgcccctactctattcctggctctctgtctttgcccatctcttctggacctttctgatgtgggagcctgggcagctgaaaagaaatgaagactaatactaatgggattaacttattacggtaactgtatttgccttgaaactctctcagtaaaagcccatttatcattagtaactgcaatttaaattcaaattttcatgagaccatctaaaatgtaaagtctatcagagattgttctggtctgcctattatacttgatggttttttagtatcaatattttggaatcaacattttcgtgtatatgtcacacaagcaaatgtcagcctttcactggaactatcagaaatgggtgattttccatcctatttctgctacccctttttgaccatgtcacaaaattgtgcatatacaagttccttgcctggtgaccaaaaaagcagagtcattgttttattcacattcttctagataggaaaatagctaatctaagttgtcagaatttatctttttccccaagagactcaataaagctttttgcatttggaatggaaaagcaaatgcagccttaagcctttcctgttcatgaaatggttatcacaccaaaagaattgctcaccactgccctgtctttttttgtcagttccgcagaaagggaaccttctcatttacaccgagtttggcaagatgcttgtacagcccaatgagatctgcgtcattcaggttggtgatgtgtccccttctcttccctgcttctcactaatttgggagcagtcagatgtttcagctgctgctatttccaactctaaaattcgtctgtcatgtctggacaacgaggagggaatctgagttatgcagaaggttccatgtgctgaagagtaagcaagcttgggtgcctgctttcttttaatatagcacataattctaaaggaaagaccacttgtcattgcactttcctaaatatttacatatactttggataaggccctgttcccactaatggcagtagaggcagtgaaggtggactttttttttttttagtgtggctaaatcaggcttaccattatctctggacccaatgagagggtagactagaattggcttgggtcacatgtgtgattaggaattcagtttttctttttaaactgaattttaaaaatttctttttaaaaaaattcagtttttcatgtttgctctggtcacctcccaagcagctcaacaaacaagagctttacttttgcatgtgggatgggctatggctctgggcagcttctttataactacagctgtgatttcagagggcacaccagtgtctgctttccattccagagaggaatgcggttcagcatagatgtctttgaggagaccaggggctacatcttggaggtctatggtgtccactttgagttacctgaccttggaccaattggtaaatcttcattacaagcctctaagcctcgcttgagatgtaggactcagataattgcatgaaagttaaacatccttctcccttcgctgtctcactcaaacttccacttttctctctagacaaattcttctctagaccaagtgtcttcccagaaaatatatgcaaaacagaaagcaacccaaaccaatccattataaatctctctagaatagtatacagacattggagataaagacggcatgtaatagatttctggttgcatagtgtgtacaggaaagaatatagaagtttgggttactgtgggcttgggtcaccagaaacagctccacagaagagatgagaatttgactaattctttatgaaaagttgaggagagtaaagaggaaagggaacagctttgcaaaagcatataagtgagaataagctttgtgattaggaggaagatatttttgttaagtcagtgagatttataatggattggtttggattgctttttgttttgcatattgtataaaatgggaaggccataaaaatgccctgggctgtattcctatggaaaggagggatggactgggtgacacatagtctatgaacctctgtgtacaccccaccaaatccacacacttagcagtcaaaaaaacacatcactcagtgctatgagagatctagaaaccacaccccaggaggcagattaaaacattccaaagtgaaccaaggtctccacagcccccattcttctggcaagctggaggaagtgaaaatgttaggaggggttgttctcaaactgtctcttggattgaaagaaaaggctgggaaaattggcccttggtttactctttggtcacatctcccaattctcccttccttgtcaacagctttttagagcaaacagggacaggccagtgtgtgccttctggtcagctcctctgaggaatccaaatatgcagaggaaggtgggaggcagcaagaggcagctggagccgtggtgggccgtctgtcatcctgttcacctcccactcttcccatcctgctctggcttcctgctgctctatagtcagcatagcctccaggttccgtggaacatgtaccctctggaaaatatctataatttgctaaccagccggggacttatttttttaagtcccaggagctggaaatgataaaacactcctcagctcgctcctctcagagttaaactgtttttgcacttaagtttttcatgtttggtcttttgatttatttcctttctctggaggaaacactcactcctaagcaaaggtaagcaggcaggtcctaaatacttcttcctgagtggcagacagggtttttcaggctggagaaccgttttcagactggaatctgagttctgtctagggagcagaggcatgccttaggcaacagcgtgtaaccctttctatctgagatcaaggactgtcaatgacttctagaatattcaagggttccttcaaaagaaaaagttctggagttctatcagatcttcccttttcctcttttcagttctctttctctcttcccttcccctcacctgtagtgataagataatgcatataagattgttttgttaaccatagtcactccacaaccttagaaagtaatgctggtttttgtgaatttttttctgaccagattccttgggtcttcctaaaaggtaccagactggaaatgcagtgaatctttgagcaatgaaagcaatttgtggagtagctcttgacatgaaagaaagcctttctcttcatgcaaccatgggcatctttcctatgttttggaagtttctaaaagacttttgggttactgttttctaggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggcagtaatgataaataatttaccaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttctgaaaagtaaatgagttaacagatcagccaagatttatagtctccaataccaccctatttcaaatacaagcaatcctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaagaacccaaagatctcttctgtttagcattatttgtttgcttcattttgtctatttgaattattccttatattttccaaggtatgttattcttcttaggcagcatctagagataatgccaaccagccgaggccaaccagtttggcacttaaaattaacccctgaagcagacatattgttattctcttattctctgggtcaaggtctctcaaaattcggggggtatttgcatcagaaatcctcaaggaggcttgtttaaaattcagatcctaggctgggcatggtggctcatgcctgtaatcccagcagtttgggaggccaaggcaggcggatcacctgaggtcaggaattcaacaccagcctggccaacatggcaaaaccccgtctctacccaaaatacaaaaattagccagatgtggtggtgcacacctgtaatcctagctacttgggaggctgaggcaggagaatcgcttgaacccaggaggtggaggttgcagcganccaagatcatgccattgcactccagcccgggcgacagagcaagactccctctcaaaaaaaatgcagatccttagatactactctagccttgcaaaaaatgataagctttggagatgggacatggaaacctacattcattttaagcatgttccccagatcattgtttacatacaattgttaaagaaccacaattgtagaagcagccagtagctcctccgaaaggtttgcactttccaagtggaccctgtgctggttattttctgtgtgagtcccactgatccattctccctctttgccatgatctgtgccctggaagttgactgtatcacccgggctccctaaccactggtttctgttgggttcaacccacagggaaactacaggcaggaagaaagacaaattgggatatttcttcccctgcttcctcgctgtttaagaatgtgtttctgacagtagctgcatcccccatatgacctcagttcctgttgggtaaccctagtggtgggctggagctgattcatagtgacttgcaaaagctgatatgcacgcttctgtccaactgtgtatttgttgatgtcatactggtagctaaaaaatcatcatggtgagactgtatacaccttagaaatcagtaaacactatatgtcaatgctttatgtatttttttcagagtgctagttgtgaaatatttaccagcacaccactgggtaacacccttctttataattctagctcttgctaaagtcctataacaatatttccctcctcattccacatgcccaggaatagcagtgtcttcccgctattgctaggctcaaatacctcaacatttctagtcattccagttaaccctaaccacgcctctatgagtaacgccttcattaaaatctttagcacttttcggaccatagatacgtttggacctcctttcctatagcaggacactgattctcttctaccccaggacagggaccagggaagtattatgttagggattgcttctgaaatctcaagtcttgggagttgggaacttttaggaggccttcttcccttcttcctggactcaccaacccaggcactgtgtctattgcaagctcctctaggctgaaattacctggagaagcatcacagcaggtactctctgttccaggaaacagaaggtagcccagattgtttgagacctgctgacaatccacagatcctcacagttaggttaaaaattgttgaaaaggcactacttggagaatgtgctgtgtttcctgctgcatgtgtgatcagaaggcagctgcagcttatgaaccagaaaaatagggttagtggctaagtagagggtgtgtggagcaaccacaaaatgattcagggttatacttctcccaaaggacggtaaaattaaatcgagaacaaaatcaaatcaaaagaagagagaggtatactcagtacatattgtgggatcacagctacaaaagcattagatggtaaaattatcctttcctgctttttgtgtttaggatgtctccccgttcaatgttgtggcctggcacgggaattatacaccctacaagtacaacctgaagaatttcatggttatcaactcagtggcctttgaccatgcagtaagtctgaaccctgtaggggccttgggatgaggcaacgcttgggtgggaggggtccacagtagacccctgacatttacagatctaacatttccaatgtcaccgttgggaagccctaaatatagtcatttgtcctttggtgagggagtaaataacacaactagtagggaagcaaagccagatactcaacattcccctgtgaaacatagcttcattctctacagagcattggtgatactctgacttgtatttgccaaactaagtggataaacacttagtttctttgtggaaaatttatcccccaaaacaaccaagtgttaatgtcggtggtagaatgaggagaaaggaactttatgaatttggagaagtccctgaccccacaactctcaagagcctcctctatgatctctgacttctcaccccagtgccttcattcctggctgtatttggcagtgacagagtgaacagcccacttctaaagttactcataactttcagtgcttgagtttaaaccaaagaaattctagagcatgaacttggtcatatttttcactcagttcgcaggccacaaatggtctctggtctacagtgcaggctcccaagaccctacattcttaataaagtggtggttctgagaccccggggggaagttcattttgcagctcacttcataagagatgaacctaacccacaagctggaaggataattagagcagaagtcagagactcagaggcaaaaggattattgtgagccagttcagtttatctctggggggacaaacctacctctccaaacagcagcaactcttaataaaagcaaaggggaaaagaaaagtgagacatcagaccccaaacaaacagcacgaaaaaggatcctgagacactgataaagctttatttgtgattcactacctttgctttaatagtttcagatcatgtcccatgacagttgaagaaatgtcaattctcacagcaataagggttgggtttatttttatttgaatttacacagatgcgatcttctctgtatttgctgcaatagttatttttccaaaatttagttctgatcatgccaccactgtctccattagaaagcctttgcaggttcccatgggcttaggattaagtctgcactctgaaccatggtgtttgatgctcttcaccatctgtcccaccctggaatcattttccagtatcacctcttgcccctttcccttctgtcaaagcattggggttttagccttctctcctcttaacaaaatttttgtgcactttgatgtgttttcagtgattaaaangtcatttcccttccttcccanttccttagtcctccctccctccctccctccctttttcccccatccccggccacgtccttcctttctttttttttttttaacttttattttaggttcaagggtacatatgctccttccttccttccttctttccttccttccttcctttctctctctctttttctttctttctgttcattcttgaagacctacctcaaatgtcacctcctctttgaagccttccttgacctttcaggtagaattagctgcccaacccccaccccacaattaatgctaaagaagcagggaatcgatccccatgatctttgaatctccagactcttacatggcatctgaaagggaacatgattgttgatttcaattaaattgaatctcaaccttctcactaaagaattctgaagagttttaaaaagtataatttcgtccctcaacctatcctatctctacactaccactatgaagactacggatgtaaatgctgtgttttagacctgaaagtcaaacaaaggtaggaaagcaatgaaccacttctcagacttttctgccaatggatacaatctggaatctccgtattctcccaaagaggagcacatctacaccaaaacttggattttgctttatttctatttctactttgctctgagcatcccttctgctgcacatctcagctctagtcaacttgatctgaggttgagaagcaggcaccgttggttctcatacccacggggtaataagttgcatgtaatgtgggctcagcagggtgaaaaagcagttcagaatccttttagctggtgttaattcattttgcctcaagcacagcaagaggaaaaagtcatatgagtgattattgcaccttgatgacaagcccagacttctgttgtttgatcagaaattaggctgtccgtttgcagcaacatggatgcagctggaagccataatcctaagcaaattaatgcaggaatagaaaaccaacttctgcatcttttcacttataagtgggagctaaacattgagcacccatggacataaacatgagaaaaatagacactggagactactagaagggggagggtgaaaaaactacctattggatactatgctcgctacctgggtgatgggatcctgtattagtccattttcatactgctgtgaagaaatacccgagactgggtactttataaagaaaaaggggtttaacatatccacagttccacatggctggggaggcctcacaatcatggtggaaggcgaaggaggagcaaaagcatgtcttacatggaggcaatcaagagagcatgtgttggggaactgccctttataaaaccatcagatcttgtgagacttattcactatcatgagaacagcatgggaaaacctgcccccatgattcagttacctcccaccgggtccttctcacaacatgtgggggattatggaagctacaattcaggatgagatttgggtggggacacaaccaaccatatcagatcctaaccccaaacttcagtatcacacaatatacccatgtaacaaaactgcatatgtatccttctatctaaattaaaagttgaataaaaataaataaaaaaattagaatgtcacttgcaaacacttcatgtatgcatgaaatgtgtgtcattgtccagtcacttcccttgcatcatgcgttcagtctctccttgtgtgttcacaggacccatccattttcacagtattgactgctaagtctgtccgccctggagtggccattgctgattttgtcatcttcccacctcgatggggggttgctgataagaccttcaggcctccttattaccatagtaagtctctcttttaccaagccacatttgcaagccaaagagacaacaaagcagtgagcgctacacattgggaataatgcctgggttatttctggacacccaccatggcatgaattcaggatcctgctgcacaaggcctagtgctgatccccaagctttaatctctttaagggatggtagttgtgttagtccattcttcgttgctataaaggaatacctgaggctacttaatttataatgaaaagaggttcatttggctcgtggttatgcaggctgtacaagcagcatggtgctggcatctgtttctaatgaagcctcaggaaatacaatcatggtggcaggcaagagggaagctggcatatcacatgatgagagcaagcaagagaaaggaagaaatccccagcttccttttgaacagccaaaccccatgtgaactcatagagtgagaaactcactcataaaccgtcatgatggcaccaagccatttatgagggatctgcctccattacccaacacctcaanccaggccccacctccaacactggggatcacatttcaacatgagagttggagggaacatacatccaaactacatcaacagtgatgcattgattctgagcctagttcccagtttctctgtccctgtaagaggcagaaaggctggtaaagtttagaagccttgttagaaaggcttctaaacaagtttcctcacattttagatgtttccttttggggaatactggggaggttgttagttagtctgttgttttgggaaagttcatcacctaagtctggttcagagaaccagagaaataagaagagagagacagagagagacagagagagagacagagagacagaaatgtgccttctccaattattttggcagggcaaagcagactgcagaacatttgttgcctagtacaagaactaacaaatctactatttttattttattaatattattattcctaccccttataattattggccaatttctatggcctgttccaagttttttaaaaacttactcatgaagtgtttataatcttgtaagagacaggtagtattattgtcccccccgctttttttttttttttttcagaaaattaaactgacacaagagggattaagtaactctctcaaggactcacagcaagttaagtgtagagtcaggatttaattgcaggctgtctgataccagagcaaacactcatgaccactaactggtatggctagcatagtgcctgatatatagcatgcttttaataaatatttatttaataagtgaatgcatcaacaagaataaataaagtacttcacggctgtacttaatgaggttgacatttttaattgtgcaatagctagctgaaaatccaatcaaaggtcaatgtgcaattctacttcctggagtgtgcatttttttgtgcatagagttctggaaagactctaagaggcattccacctggaacattctagaaaacaaattcctttctttagtaaactccagggccttctgtttataataggtccctctctatatataccagttcccaggtgtcagggctcaacagaacacaacagtgcactgaatggccaatttagctattttatagcatcaggaatgaaggcccttaggatggacgtaggccactccatggtcaaatgccagcatcccccttttcagatggcaccatcatggtagagaaaagaaaacaatcagttaccatggcaaagacggcagctattttgtgaatagcatcataagtcgtttctaaaaactgtgaagcctactaaagactctaacttttctcctcctggaagttagtgacctagaggacctgttgtcaaggagagaaaattgccctggcttatagtccgtacttcgcatgttactccttaataattcaccatttcactcttgttcttgtattgaggttactctgtgtgcctgtagtggttcttacattttaccatgtgtcacagtcagctggaaggtttattaaaacacagattactgggctccatcctcagaatttctgcttcagtaggtctgggataggacctaagaatttgcatttttaacaagttcccacaagtgatgctgaatctgccttttttttttttttgagacagggtctcactctgtcacccaggctggagtgcaggtggcacaatctcagctcactgcaacctccaccccccaggctcaagtgatcctccccgctcagtctcctgagtagcttggaccacaggtgtgcaccaccacacctggctttttttttttttttttgtattgttagtacagacggggtcttgccatgttgcccaggctggtcttgaactcctaaactcaagcaatccacctgccttgacttcccaaagtgctgggattacaggcatgagccaccatggctggccagaatctacatttttcactggcaagtcaggggattctgatgaaggaagtttacagactgcttgttgaaaaaatactggcctaggtgtgtcccatccctaggtggaagaataatagaggtccatctgatttagacaagttgctactgtgctatgggtctcaacccatccttaatttttatttgtagttcagactcgctgacacaaataatcttgagagatgcctcctatagttttttaatgactcncaaagtaaatttggccccagggtagatcttataaaggtatgggtaccctgagttcgttgggaaaaaaccacagaaccccaggttagaaatgagttttccagagatattaaaaatattgccttggcaatacncaaaatctttgctgctttgatgtgactttattataagagaaaatggagaattatttctatagaaatattgcctccagtcatcttaatgtgccttagtcaactagattcagctttttttttttttttttttttttggagacggaatctcatctgtctcccaggctggagtgcagtggcgccatcttggctcantgcaagtttgcttcccgggttcatgtgttttcctgcttcagcttcctgagtagntgggatacaggcgcccgctaccacgcccggctaattttttgtatttttagtagagacgaggtttcaccatgttggccaggatggtctcgatctcttgacctcgtgatccacccgcctcggcctcccaaagtgctgggattacaggcgtgagccactgagcccggcctagattcagctttaatcagaaaggcaaggtctatcctcccactgtcctttgaaatatagaaaatgatatagaaatgtcatcaccaagctcactgctatctaaattcatattcagatcaaagctgaattctgttttgctctcttcttaaaattaagccatgaaggtgaccctgaggacacatactagagcaaggagcttgacaccaaatttaagtcatgagctgaactgtttttaaaacatagacaatttatgcttacatttgcttctttttctgtatttccacttcatagagaaacaagtagaactatgatctgggtctcacctcttcagcaggagctcacacactctcactcactttgtaggggcctgcagtagctttctgtttctgagcagggtgggtgtggctgcttagtcaattataaaagcatttggcacttggttatacttcacatgtaagcaagaagggcaggcatgtatcatgtccagtgtttgattttgtaagggttgccactgccacatctctctattctgtccttggtttgccctctcagtactctcacaggacagactatgagtagctttaaaggctatgttgttgttgttgttgttaattattcttttttaagtagctttaaaagctatttcttattcatctctgtctcatgttagccagcacatatctaattatatgtgctggctaactggatgggcagatgggtgaagtgggaaaaagacagatgaatgaatgggtaagtagatgtgtggtttgagatgcaaaggcacttaaatttgcccaggtgttatatttctttaattcctgctctattgtattgctactctaataaagagctttatttcaatagaagcataagattggaagagtggaagcatggtgatttttgttaaattttgtgtgactctagaaagcacaactaggaccaatgaatttaactcatataaaagcaaatttccatttaatataagaactttcttacacacagagctcttcaataatatgatatgctttgtagagtggagagcttccattcacatccaggcagagcccgggaggtaatcagtcaggaaagatatagaaatttcttctacattgagtagaagtaaggataccttccaatttcaagatttaggactctatgaatagggtatcaatggaactagaaaaaataaaaacaaatccaaaagacattctgaagaacagaaaaacaagaggataacagattcatctatagaagataatatttgttataataaatagcatttatggtctgttttatacacataccaagattctttcacacagattatcatttgataatggactttaagtctggggttcttttcattacattatcatctatcatccatcaaaaccacacaccctcaatctaagccttctagattgggaattagaaatatgctgttgctgtgtcctacagtggagctacttgggaaagggttatgatttgggagataaagataacttttgataacagggttcgtaaagctttaggatgatagagaacatttcggttttctattatgactagcattttaattattattattttttttggcccctgattttttttagatttagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttcccagggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggtaagtatgttaactgccacattccagcggcctctgaactccccacccttactgagaagggttgccgtttttcatttctccaaagtcacagaggaagaatcaaaagaaggaaagttaatgactgcataagtatgtttacatgtatatatactcacatccttgtgtatatactagacttctgttgtggtggtgtaggaaagatcattgggacttgggagtcagacctggttctggagtttaagtcccatctcttagttcctacaggatcttgaacaactcaacttagcttctctgtgcttcattttccccatctataaaatgggtatagtatccaacccagcagatggctatgagttaacctaacagactgtccaacactattcaaatgtaagggaacattattaatactatgtgaagcctcttcctgtatccttatgcagccctgggcatatgctatgtctcagagtcttctgcgttttgaagtaatcctccagggccacagtagtagcggaggcaggatctcaccttcagcacgtgtttcaagccaaggagggtcaaaaagcccttgcctcactatagtcagggcttgtgagaagcaattctcagctgttttttgcattttcctttgctctgctttggcatggatgcaactgatgggatttaaaacctgttttgtattcttcctgtgtcaggctgtaaacattgaggctgaacacaattgcagctggctgcggtgcttgattttattttatttttgcattcttcgaggtaaagtttatggtccacagggagtaattttatgctaaatcacatgcaaatttgctttacttttgaaaataaatgccttcaatgctacctggtttaaaatctatagcaaaaacctgcctgcttcatgcttgcaaactacctaaacagtgagcattatctgtccgtctgtccactgcagtttgctttcagtcccaaccctggagccagagttggtggactcctttgcaaaaggaggtgttcagagtcccatttgcttgctttggctctatttcccctttcaagggcctctatggagtttctgtaaaacccctacatctcaaagagatgcagtctggcagtctcagttaaactattacctctgaaatctcctggaagtgcaatcctggaagctattctagagttgccactcaataacctttgttcccccaatttggctttgggtagtcaatgttatgagggagctgtgttttacaacagtgaggcgtaggacagggctgtttctatgaggagcaatactttgaattactagtgagaaagagctctcctattaggatgggagaccctgggtatcaaggagccagaatacctgatggcggagggtccaacatcttacctagacctaactttcagtcgtcctcaccatttcccattatataattcagacccaggtctatctacatgccttatccttattcttgtttggagtgattaacttggtacaatagcatcttcaaagtcagctgggatggggcttttgttaatccagccaaatggagaggcttttaagaagcagtcagcaaagagacaatagcaatggccataatgatccttgtatgtgaatagtgctttttaaaaatctttattacttattatttattatttttatggatacataataagtatgtatatttatggggtacatgagatatgatgatacaggcaatatgatacgtaataatcacatcaagataaatggggtatccattacctcaagcatttatcctttgtgttacaaacaatccaattatattctttcagttattttaaaatgtgcaattaaatttttattgactatggtcaccctgttatgctatcaaatgctaggtcttattcattttttttcttttatttctttatttatttttaacttttatttgaggttcaggggtacatgtgaagatttgttatataggtaaactgatgtcacaggggtttattgtacagattatttcatcactcgggtactaaacagtacccaatagttattttttgtgattctctccctcctcccaccctctattctcaagtaggcatcagtgtctgttgctcccctctttgtgtccacaagttctcatcatttagctcccatttagaagtgagaacatacaatatttggttttctgttcctcttagtttgccaaggataatggcctccagctccgtcgtgttcctgagaaacacatgatcttgttcttttttatggctgcatagtattccattatctgtgtgtgtgtgtgtgtgtgtgtgtgtgtgtgtgtgtatgtgtgtgtgtatgtgtatatatatatatatatatatatataaagctcttaagtttaattagatccatttgtcaatttttcttttgttgccaattgcttttgatgtttttgtcatgaaatctttgcccatgctgatgtcctgaatggtattgcctaggtcatcttccaaagtttttatagtttggggcttaacatttaagtccttaatccatcatgagttggtttttctatatggtgtatggaagcggtccagtttaaatcttctgcttatgactagccagttgtcccagcatgatttattgaatagatagtcctttccccattgcttgtttttgtcagcttcattgaaaatcggatggttataggtgtgcggccttgtttctgggctctctattctgttccattggtctatgtgcctgtttctgtatcattaccacactgttttggttactgtagccttgtagtatactttgaagttgggtagcatgatgcctcctgctttgttctttttgcttaggatagccttgggtatttgggctcttttttggttccatatgaattttaaaatagtctttcctagttctgtgaagaatgtcgttggtattttgatatgaacagcgttgaatctttacattgctttggatagtatcgtcatcttaatgatgttgattcttcctacccatgagcatggaaagtttttccatttgtttgtgtcttctctgatttctttgagcagtgttttgtaattctcattatagagacctttcacctctctggttaggggtattcctaggtattttattctttttgtggcagttgtgaatgggattgcattcctgatttggctttcagcttgactgttgttggtgtataggaatgctagtgatttttgtacattgattttgtatcatgaactttgctgaaagttgtttattggttgaaggagcttttgggctgagactatggtgttttctagatatagaatcaggtcatctgcaaacagggataggttgacttcttctcttctggatgcactttatttctttctattgcctgattactctttgccacgacttctaagactatgttgaataggagtggtgagagagagcatccttgtcttatgctggttttcaaagggaatgcttccagcttttccccattcagtatgatgttggctgtgggtttgtcataggtggctcttattattctgtgatgtgttccttcaatgcctagtttattggagagtttttaacttggaagatatactgaattttattgaaagccttttctggcatcttggaatagcactggtataacttgcatagcacttccatatgatctcatccatcaagcctgtcacaggaaatcaggcagcgatactcatatccattgttttagacaaaaataatttaatgtatattagagcccaaacattaatgtgggtgctttgggttgtagcacaagataattctattattttccttttgcctgtctgtattatacaaatttccaaatgtgagcatataagaattgtagggtttggtttttgggttttgttttgtttttaaagccacagtggataagaaaagtcagcaattgatgaagctgtaatgtctaagatgcacagagtatttacatattctttctgttgtggacaaaaacctcctgacagtgcaacatccaccattcagacacttctgagatatgacttttaaaagtgctacagccattcctgcaatttccttcacctccctctcctcacccactccctttttcccttttcccagcccatctcttggtcagagtcctgaaaagacaggctcaaatcccagttctgcgatgacttgtcgccttaagcaagtcgtttcccagctctcagccttaattcctcctctgcaaaatgggaagtatgactttcctcacaaggacatagccacagtaagtgaagccctcagaagatggatattcccaggattctcccatgtctgcccttggatctagcagacttagttccgtaataccatgaagataatttgaggttaagggtgaattttattttacagaatgaaanttgaggccctgagaagttaaggtcttgtaccaggtctcaccagcttacaaatggtaggaccagagccacaactcagggcttgagcctgctctcctcaccactctagcacacaaatctttgatttgttattggaaaatttcacctacccataccttctgttgacatctaatcaaatgtgtttattatctatctcacctcttttttctcatccccatcgtcacttcctccaggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagattcttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgtagtgattggtcataancaagtcttgatgagacaaacctggcaggtcaggtcagtcttgctaagattgaaccaaggcccagggccctttgccttgtggttggcctgaatgccttcattctaggagcacaagtccaggcatatactaggtatcacaaaaccaggccataaggccaaacgttaanaccatgaactgaaactgggaggtntggcaaacctcttaggatccaatccatacatggggaaatttaggggatcatgaatgccccaaatatccacctttcaatcgatnaagaaccgggccaataggctgtctaatcctggtagtcgcttnccaccaatatga

SEQ ID NO: 1544 - DNA, 760 bp, Homo sapiens
  Genbank Accession No. AF001294
agagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggcca

SEQ ID NO: 1545 - DNA, 4702 bp, Homo sapiens
  Genbank Accession No. AF003521
ggccggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaatgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacaagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggttgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccgggggggcacaaggacgtgctctaccagtgcaagaacttcacgccgccgccgcgcagggcggacgaggcgctgcccgggccggccggccacgcggccgtcagggaggatgaggaggacgaggatcttggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgtcggcaaggaatagggcggctgcagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtagccgtgcgtggcactcgctgtatgaaaggagagagcaaagggtgtctgcgtcgtcaccaaatcgtcgcgtttgttaccagaggttgtgcactgtttacagaatcttccttttattcctcactcgggtttctctgtgctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtataaaaaaaaaaaaccggaattcc

SEQ ID NO: 1546 - DNA, 1253 bp, Homo sapiens
  Genbank Accession No. AF004022
cggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacttgcaccatcccaacatcctgcgtctctacaactatttttatgaccggagaaggatctacttgattctagagtatgccccccgcgggatgctctacaaggagctgcacaagacctgcacatttgacgagcagcgaacagccacggtccggcggatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtaaaaaaaaaaaaaaaaata

SEQ ID NO: 1547 - DNA, 1838 bp, Homo sapiens
  Genbank Accession No. AF004709
gcacgagcgcagccgccacgccggggccgccgagatcgggtgcccgggatgagcctcatccggaaaaagggcttctacaagcaggagctcaacaagaccgcctgggagctgcccaagacctacgtctccccgacgcacgtcggcagcggggcctatggctcctggtgctcggccatcgacaagcggtcaggggagaaggtggccatcaagaagctgagccgaccctttcagtccgagattttcgccaagcgcgcctaccgggagctgctgctgctgaagcacatgcagcatgagaacgtcattgggctcctggatgttttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatytgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatyttatyttgatccttattaattaaacctgcaaatactctagttccaaataaagtcacattctcaggttccaggtggacatga

SEQ ID NO: 1548 - DNA, 1433 bp, Homo sapiens
  Genbank Accession No. AF005039
tgaggcgagtgaagtggactctgagggctaccgctaccgccactgctgcggcaggggcgtggagggcagagggccgcggaggccgcagttgcaaacatggctcggagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaatgctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctgggaggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccggccctaaggtctytgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgac

SEQ ID NO: 1549 - DNA, 865 bp, Homo sapiens
  Genbank Accession No. AF006041
agacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattaactgcctccccttctccctgcctccagaatgttctgggataacatttggaggaaggtgggaagcagatgactgaggaagggatggactaagctaatccccttttggtggtgtttcttt

SEQ ID NO: 1550 - DNA, 7586 bp, Homo sapiens
  Genbank Accession No. AF007216
gttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaaccttgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgcctcaaattagactagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaacttttttataaccctttaatgaacttatctgtggagtacattgaagaatatttttcttcctagattttgttgtttaaattatggggcctaacctgccacttattttttgtcaatttttaaaacttttttttaattactgtaaagaaaatgaattttttcctgcagcaggaaacatagttttcagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgc

SEQ ID NO: 1551 - DNA, 348 bp, Homo sapiens
  Genbank Accession No. C00021
  unsure (1)..(348): n = a or c or g or t
gatccgtcatggncaacgagaagcacagcaagaacatcacccagcgcggcatacgtcgccaagacctcgagaaatgcccccgaagagaaggcgtctgtaggccctggttattggctctcttcacttttgtngtctgtggttctgcaattttccagattattcaaagtatcaggatgggcanntgaagtgactgaccttaantgtttccattctnctntgaatttaacttaactcattcctgatgtttganccctggttnaacaattcagtaaanatctgctagaatncttnctatcatnttcatgtgcattcaagnttctcatngcatccangttctagncaacacag

SEQ ID NO: 1552 - DNA, 369 bp, Homo sapiens
  Genbank Accession No. C00358
gatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgctt

SEQ ID NO: 1553 - DNA, 307 bp, Homo sapiens
  Genbank Accession No. C00808
  unsure (1)..(307): n = a or c or g or t
gatcactgtggacagggtgcagctctaccagttcctgtttctnctgagccagaccctcttcagggaagggaccaattaattttaaaactcacttgaagcacagctggtcatggggcttggtataaagttcctatttccaccctgatacttccaattcctggaaccccagcccactccnccatccctcctccctatcaaactagtataatgattttgaatcggtacagtgtgtttaactgtaactaagttcgacagactattattatctttgtaataaattaacctagcaataaaaattattctgtnt

SEQ ID NO: 1554 - DNA, 359 bp, Homo sapiens
  Genbank Accession No. C01257
  unsure (1)..(359): n = a or c or g or t
gatctgttatnaaacgaaacaccccccgtgttaataacttggtatgaaatctgtttttatgagccgggccccctgtgcctctagtatacttgtattgactctcatagttacccttttagttttactgtgttctgtgaaaatttgtaattggttgngaatcactgtgggcgtccattcttattcaactaaatctccacaggttttttgagctggtgtggattagtttaactcttgtattcaaccattagtgctaccaccttctcacattacaatacanttnctggaagcaagtactgcatttcctatgcaacaaaaaaagggcaaaantacananattgctaaatgataaacaaanactt

SEQ ID NO: 1555 - DNA, 387 bp, Homo sapiens
  Genbank Accession No. C01286
  unsure (1)..(387): n = a or c or g or t
gatcacctgggtttctttatttatcgactgtgtcatgacaaggaaacntacaaactgcaacgcgagaaacaattaaaggtattcagaaacgtgaagccagcaattgtttcgcaattcggcattttgaaaacaaatttgccgtggaaactttaatttgtncttgaacagtcaagaaaaacattattgaggaaaattaatatcacagcataaccccaccctttacattttgtgcagtgattattttttaaagtcttctttcatgtaagtagcaancagggctttactatctttccatctcattaattcaattaancccattnccttaaaattttttnntttcgaggtgtggtgtctttnatatttggnttggtacctgtntggggtcat

SEQ ID NO: 1556 - DNA, 283 bp, Homo sapiens
  Genbank Accession No. C01409
  unsure (1)..(283): n = a or c or g or t
gatcttgtaccaagccaacgggtntcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttct

SEQ ID NO: 1557 - DNA, 346 bp, Homo sapiens
  Genbank Accession No. C01686
  unsure (1)..(346): n = a or c or g or t
gatcatctctaaaattaaaaaaattaatattaaatgttggaccaaggatttcaaccatgcagtatgttgcttctggggtctgctgtcctattccagccctagtgaatagttaatgccttgaactattcctatcaccacaggttgccaggccaccaaataacgaagccaatccaggatttgtccatacagaaaatgtgtgcgctcccagctaaatctcagttaaggaggttgttctatatacagccaagtagcagaaatattcataaatgtcatttgcaaatataataaacantgtaatgaatgggtatttcctttcttgttaattctatgtgctcaattaaaaggn

SEQ ID NO: 1558 - DNA, 316 bp, Homo sapiens
  Genbank Accession No. C01721
  unsure (1)..(316): n = a or c or g or t
gatccgggggcatgcagaagctgagcacaccccagaagaagtgagggtccccgacccaggagaacggtggctcccacaggacaatcgntgcccccnaacctcgtagcaacagcaataccgggggaccctgcggccaggcctggtgccatgagcagggctcctcgtgcccctggcccaggggtctcttcccctgccccctcagtttccacttttggggttttttattgttattaaactgatgggactttttgtgtttttatattgactctgcggcgcgggccctttaataaagctaggatacgcctttggtgcagct

SEQ ID NO: 1559 - DNA, 345 bp, Homo sapiens
  Genbank Accession No. C01766
  unsure (1)..(345): n = a or c or g or t
gatccagatgcagaggccaggatgtgggcccagccctgtgccaggaggctngctggaataaagggatgggcaggctggcatgggggcagccgctgcccctgcctnnntgttgctgtgtattcctgccggccaggggccactgccaggaccacgcctcccttttnatatcccgattcttaagttctgctattgtggtattctggtggagaaaaaagaaccgcgtggctgtttttnaactgcctggaacctaagaccctgaattcttttcccccccaaggggaaaatctatatggaaancatttattttaaaatacaggatgaagtgaattaaaagattttaaatgc

SEQ ID NO: 1560 - DNA, 260 bp, Homo sapiens
  Genbank Accession No. C02099
  unsure (1)..(260): n = a or c or g or t
gatcagctcgcacagaggttgtctgcaagcagtgtgaagctcatctaggtcacgtgtttcctgatggacctgggcccaatggtcagaggttttgcatgaacagtgtggctttgaagttcaantcaagggaacactgaccatcttcaagagtcccgttcccttgccaccccttcacgtgcaccctcaatttccacaattcacttgaatgacttgtnttattngcaataaaactgggctgaatttgctgctgtctccaaana

SEQ ID NO: 1561 - DNA, 388 bp, Homo sapiens
  Genbank Accession No. C02386
gatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgt

SEQ ID NO: 1562 - DNA, 351 bp, Homo sapiens
  Genbank Accession No. C02460
  unsure (1)..(351): n = a or c or g or t
gatctgaagaagctgaagaaanacaggacagtgagaaaccacttttagaactatgagtactacttttgttaaatgtgaaaaaccctcacagaaagtcatcgaggcaaaaagaggcaggcagtggagtctncntgtcgacagtaaagttgaaatggtgaccgtcnactgctggctttattgaaccanntaataaagatttattnattgtaatacctnacagccgttgcaccatatccatgcacatttagttgcctgcctgtggctggtaaggtaatgtcatgattcatcctctnttcagtgagactgagcctngatgtgttaacaaaataggtgaaggaaagtctttgtgct

SEQ ID NO: 1563 - DNA, 321 bp, Homo sapiens
  Genbank Accession No. C02532
gatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcgc

SEQ ID NO: 1564 - DNA, 266 bp, Homo sapiens
  Genbank Accession No. C13992
agggvtcagttccmgcygattttatttccyyctcaaaaaaagktatttacagaaggtatatatcaacaatctgacaggcagtggaacttgacatgattagctggcatgattttbycttttttttcccccaaacattgtttttgkggccttgkaattttaagwcaaatattctamacggbatattgyacaggrtkgttggsaaaaaaakttwaaaacaaamccttaacggacctgcctcaaacsgkcagacgkcctawktgcctbtc

SEQ ID NO: 1565 - DNA, 324 bp, Homo sapiens
  Genbank Accession No. C14051
  unsure (1)..(324): n = a or c or g or t
ccccaatacaatcaatcacctttattcccggttagaacamggccgtgcacactgcagacagaagagcacaagwtcsgggcaatctcacagcaatatacggcgcsggbgggcaggttagtctttttmgattatttcsccttacagagaaactactagactcygcyygaaaagaacccygyctctcttctcccatttnttccatagaacggctccttattctctctctcactctaaygtaacatatcccaaccgsacggacagttcatgctcattccccccacccaattctacacgtatctctctcttcttacgsgagaagccagm

SEQ ID NO: 1566 - DNA, 304 bp, Homo sapiens
  Genbank Accession No. C14098
  unsure (1)..(304): n = a or c or g or t
ccsgaatkagaaataactttatttmatygcdgggagcgggccgatgttcagcytcagaacttcyggawctgcttcttcggtgccggaagycytcggtgaccttgagaacgttgaagcgcacwtgtamttgctmagacggccggmacatcgcccacatgtgacgatgtcacacgagtcaygkgagcganncctgaacgcacggggggamacggatrtacaygacatgttctcgcgsgcgckttctcgaamgcgcgttgtactccgcgsgatgatagatgacagatagmtctcgcgcgsgactgsa

SEQ ID NO: 1567 - DNA, 295 bp, Homo sapiens
  Genbank Accession No. C14228
taaccttctttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagtaaaaaaaaaaaaaaaaactygkgggggggcccggtacccaattcgccctatagtgagkcg

SEQ ID NO: 1568 - DNA, 359 bp, Homo sapiens
  Genbank Accession No. C14348
gcagccacagaagattttttattgttgttttaagaactccctagcccccaaatcaacaaatcatgtcaggtaaatataaatattttagccaaccagtggctctcgcctgaaatcccaatgctttgggaggccaaggtggaagghtcacatgaggccaagtgttcaagtctacactgtggagggcacaagctgtgggagggcctggaagacacgcctcagagattctcccagtcctgccaccctgtgggagacacttctaaggaatcgtaaactcatgtgaccagcagggaggacaccgatgaagaaactttcctgcctaaaatcagctgctgtccagagttagcacctgggaggagaca

SEQ ID NO: 1569 - DNA, 486 bp, Homo sapiens
  Genbank Accession No. C14412
aaagaagaaacaaggacatgaccaammggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgdtttwcggcat

SEQ ID NO: 1570 - DNA, 312 bp, Homo sapiens
  Genbank Accession No. C14756
caagtttatagtctaaattttattatcyccaagtcacaatgctgaycamaaatgggcaccctttaaaacagtaacaaaaaacaccaccacacatggraaawtccttgcaactaaacamagkggsccaacagggacaactytcacagkgtyttarggtctgggaatctgggcatgctgcccacaggcttggggggacatcttcaggtttaaggcaaagggaccagcctacaaarggcacaaccaccagytwcccctaggaagaatctcttagttattycccccttggggggttamagattaagkgcctctycc

SEQ ID NO: 1571 - DNA, 353 bp, Homo sapiens
  Genbank Accession No. C14835
  unsure (1)..(353): n = a or c or g or t
gmagtaatttaatttaataaaataaaattatannvncaaaaagttacatttytaaagtaccaaaacctgcaacaggctcatggaacagagcctagggatccaggdgcataggtaggtggtggtgytgggcagggytctgyatcccctttcctcagcacagcaccatcttcaccctcctgggaaagcagcattggdgcctacaccgbttgtgcttttctcaccagggtaagrvatgcaggtwtttgcagaggggagtgagtctggaggtggcagrgcacagctagggcaagacttaagggaacttgtgggaagagtaactggaacctacctatgctctcttgacccaaactccc

SEQ ID NO: 1572 - DNA, 310 bp, Homo sapiens
  Genbank Accession No. C14963
gaaagattatttagtcctttaatgtattaaaatagtagtgagaaaatstscccttgaaatatagactctgaagtacaatttaaaaaattaaaactgatttgatatgattaattcaaactgcggttgaattgcaaggggacagctcagaagttcataaaagtttcaaattagtcacatttgttgaaaaaaaaaamcataaatgcaggbgcctgcaatgtttacattgtgtcagatatttcagagccatgtataatgttgtcttgaaatcctaaacacttagttttttaaaacatttctggttactgrggrg

SEQ ID NO: 1573 - DNA, 308 bp, Homo sapiens
  Genbank Accession No. C15078
  unsure (1)..(308): n = a or c or g or t
agaaagccaagbtcttttattaaaggtcccgactggttttcccactgtatttccatgccagccagggnvagggacagcctctcgggaggtaccgggtggctgggcctggggccggtagcacagcgcttaacggtatctgcctgctccactccasggggccagagcaccagcacgatgccgcccsactcggctctgcggnggcccctktgggcctkcccttcctttagctccagctgytgcccggggmatccccgstcattcccgctgsgagtccgggsttgctatctaaggbctcccccagtbbhcac

SEQ ID NO: 1574 - DNA, 297 bp, Homo sapiens
  Genbank Accession No. C15324
  unsure (1)..(297): n = a or c or g or t
agggttcagttccagctgattttatttccttctcaaaaaaagttatttacagarggtatatatcaacaatctgacaggcagtgaacttgacatgdttagctggcatgatttnnncttttttntcccccaaamattgtttttgkggccttgaattttargrcaaatwttytacasggsatattgcacagggtgggtggcaaaaaaaagtttaaaaacaaaaacccttavsggrmcygccttaaaaaggvagacgkcctagkgccygtcatgttatattammcatacatacacacaatc

SEQ ID NO: 1575 - DNA, 387 bp, Homo sapiens
  Genbank Accession No. C15871
gtcacccaggctggagtgcagtggcgcaggctcggctcactgcacctccgcctcccaggatcaagcgattctcctgcctcagcctcctgagtagctgggattacaggcatgctccaccatgcccggctaatttttgtatttttagtagagacagggtttcaccgtgttggccaggctggtctcgaactcctgaccttgtgatccacccgccttggcctcccagagtgctgtgattacagctgtwgagcctccgtgcccagggcagtgttctctcttaaatgtgtttcaatatggtggacatttattgagcacttgtgttgggcgtttcaacaggaggcactggtacgaaaagtagcttgttctagttcatatatcattttgcacttt

SEQ ID NO: 1576 - DNA, 301 bp, Homo sapiens
  Genbank Accession No. C16420
tgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaacattcttttcttttatgtataattaggtttatgtttcatgtctttttaaaaccttataaaagatttamttatcacatctattcttcaatgtggaaatattaaatattgttggttgtaaaataatatttatgtactacttgtgtctg

SEQ ID NO: 1577 - DNA, 456 bp, Homo sapiens
  Genbank Accession No. C18029
aagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgctt

SEQ ID NO: 1578 - DNA, 280 bp, Homo sapiens
  Genbank Accession No. C20653
  unsure (1)..(280): n = a or c or g or t
gatctaattgtgaaatcgttcaccttgttaaacatctaagtaagtctgtagtcgctctgcaaacagccattatatttatttactctagaagaaactgtagagtagtaattcgtgctaatgagaaaaacaaaataccatgttcaaaacagatgtatttgaaaacttaatgacatggttccaaaaactagagcatgtatgtatgctgtgcatcatctcagcagacctaaaatatccccaagttgtccctttacagccatcaatatatttnacactctgcggc

SEQ ID NO: 1579 - DNA, 345 bp, Homo sapiens
  Genbank Accession No. C20810
  unsure (1)..(345): n = a or c or g or t
gatccggaacccactttttattcactccccatgtctttggccttcctcttctttctctttccctctgccatcctgacactgatagtttgtcatataaattccacaggttgtgtttttttttctagaaaaaaattaaaagggaaaacaaaaccaaaaaaaccagaaaccacgaataagaatggaaatgacaatggctgcctgtcatttttctgtcacgnttttcctgatttggtttgttccctttgtctcagagaagcaggagatgttgatgagggctctcttcagggagcagcccatttaggtctcttttgttgtttgttagggagaatacacatctttcttngg

SEQ ID NO: 1580 - DNA, 355 bp, Homo sapiens
  Genbank Accession No. C20911
  unsure (1)..(355): n = a or c or g or t
gatcngttcagccctgaaaagtccaaactcccaggtattgttgcagaaggncgagatgacctctataaatcagatgcattccataaggcatttnttgaggtaaatgaagaaggcagtgaagcagctgcaagtaccgctgttgtgattgctggccgttcgctaaaccccaacagggtgactttcaaggccnccnggcttnaaaaagtttttataagagaagttcctctgaacactattatcttcatgggcagagtagccaacccttgtgttaagtaaaatgttcttattctttgcacctcttcctattttnggtttgtgaacagaagtaaaaataaatacaaactnntnncatctc

SEQ ID NO: 1581 - DNA, 292 bp, Homo sapiens
  Genbank Accession No. C20974
gatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaac

SEQ ID NO: 1582 - DNA, 261 bp, Homo sapiens
  Genbank Accession No. C20982
gatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgt

SEQ ID NO: 1583 - DNA, 262 bp, Homo sapiens
  Genbank Accession No. C21130
  unsure (1)..(262): n = a or c or g or t
gatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattganttttcaagtgccattataaagttttaaaaattatcaatatgagttggtgcctaatttttnntttcctaaaaataaaatttttcctttttatgagt

SEQ ID NO: 1584 - DNA, 278 bp, Homo sapiens
  Genbank Accession No. C21238
  unsure (1)..(278): n = a or c or g or t
gatcagagaagctaggagagctccagcaggggcacagaggattggnngcaggaggagtctggaacacagccttcatgccccctgaccccaggccgaccctccccacaccctagggtaccccagtcgtatcctctgtccgcatgtgtggccaggtctgacaaacacctgtagatgactgntggccnaacctgggncctgnncaggaggttggagcagnaagggctctccctaggggtggtgtntctcctctagggtattgggntgcatgtnntgcactn

SEQ ID NO: 1585 - DNA, 226 bp, Homo sapiens
  Genbank Accession No. C21248
gatccttgacgaggagagagagcttgaaaagctgtttcagctgggccccgcttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacag

SEQ ID NO: 1586 - DNA, 2011 bp, Homo sapiens
  Genbank Accession No. D00003
gcaagagcaaaagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaactagtgctagtgaaagaatgttattctgtcttcacaaaccgcgagccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaacgagagacaggcaagcctgtcaccttgaaagacgtctttggggcctacagcatggatgtgatcactagctcatcatttggagtgaacgtcgactctctcaacaatccacaggacccccttgtggaaaacaccaagaagcttttaagatttgattttttggatccattctttctctcaataacagtctttccattcctcatcccaattcttgaagtattaaatatctgtgtgtttccaagagaagttacaaattttttaagaaaagctgtaaaaaggatgaaagaaagtcgcctcgaagatacacaaaagcaccgagtggatttccttcagctgatgattgactctcataagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaagggtgggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaaggacttctgctttgctcttcagaaatctggtgcctgagaacaccagagacctcaaattactttgtgaatatgactctgaaatgagatggcttcatccaatgaactgcatagtatccggagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagta

SEQ ID NO: 1587 - DNA, 1362 bp, Homo sapiens
  Genbank Accession No. D00017
catttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 1588 - DNA, 1394 bp, Homo sapiens
  Genbank Accession No. D00097
agccatcacttgtctctaataaataactcccattgattttccagctcagggctcaccactccttaccgtaagcgcaggaggagactggaaaatcactcacatattattggtgctcttcctcccccatcctcacccaaggtgcatataaaccctgaataacctgaagtctaagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacaggtaaggaggtgaaggaatggtcaagaatcataaagtgagaaaataggttgaagctgagatatcttttccctgcatttatactgaaggtcattatctttctttctttatcccgcagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagtctttcttctttgaatttcctatctgtatgtctgcctaattaaaaaaatatatattgtattatgctacctgcatttgtttagtgcttgtcatagtcccatatctttatcttatgtctactacttatctatctactaattggtgtttcattggtaattggtgtttcattatcctgaaaactccaattgccaagtacggggaggaaaacctgtaagtaactagaaagatatatcgcaaagccagagcactcaa

SEQ ID NO: 1589 - DNA, 1971 bp, Homo sapiens
  Genbank Accession No. D00408
gtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttac

SEQ ID NO: 1590 - DNA, 18596 bp, Homo sapiens
  Genbank Accession No. D00596
cctgtagtcccagctacgcgagaggctgaggcagcagaattacttgaacccaggaggcggaggttgcagtgagccgagatcgcgccactgcactccagcctgggtgagagagcgagactctgtctcaaaaaaaaaaaaaaaagaccgccagggctcaaacaaaaaacctcggaaaagccctggcggtcttttttttttttttttttttttttttttgggacagtcttgctctgtcgcccaggctggagtacaatggtcggatcttggctcactgcaacctctgcctcccaggttcaagcaattcttctgcctcagcctcccaagtagccaccacgcccagctaatttttgtacttttagtagagacgggggtttcaccatgttgtccaggctggtcttgaactcctgacctcaggtgatccacccgcctcggccccccaaagtactaggattacaggcgtgagccaccgcgtccagcgccctggcggtttttaatcaagtagaaaagctgcattataccacttgcttcggttgcttcagtgagaacgaagaaatggaaatgcaaatcccttattagttgtaggaaacagatctcaaacagcagttttgttgacaagaccgcaggaaaacgtgggaactgtgctgctggcttagagaaggcgcggtcgaccagacggttcccaaagggcgcagtccttcccagccaccgcacctgcatccaggttcccgggtttcctaagactctcagctgtggccctgggctccgttctgtgccacacccgtggctcctgcgtttccccctggcgcacgctctctagagcgggggccgccgcgaccccgccgagcaggaagaggcggagcgcgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagaggtgacgccgcgggcccctgcgggacgggtggcgggaaggagggaggcgcggctggggagagcgctcgggagctgccgggcgctgcggaccccgtttagtcctaacctcaatcctgccagggaggggacgcatcgtcctcctcgccttacagacgccgaaacggagggtcccattagggacgtgactggcgcgggcaacacacacagcagcgacagccgggaggtaagccgcgtcccagcggctccgcggccgggctcgcagtcgccccagtgatgccgtggcccccgaggcgggcgtcatcgggcagcgtttgcccagtgctggagggttagggagagctgcctgggcttgaccgcgcgccggtctcaaagtcctggctttggcccctcctccgttttcccctgtggaccattccgcttcgcagcgttttcaaaaactggagcgaaagtgatgtgggcggggcaaaggcggcgggaagaggacagcactgaagctggcgcgggaacttggtttcctggtggcctcccatccaatccccacgaaccagctttcctcttaaaccttgaaaagagaaattcgggagttcgagttcttagtcgtcctttcctctttcctttccgacaggagcaccccaggcaaaaaatgtctcgcgggtcattggcgccaggctttcaggggacagtggggcggggcggggtgggcacaggacgttaggcagccgttggccctccctaaggccacaccgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaagataagtttttacactttcatttctctgtggctcgacacttctgatgcctccctttttgttcctgggacacatgcttggtgttgtcttcacacctttgtgacaggattagcactagtgggcagtggatgatagctcctcctcccttttgccacatgttcatccctgccctcgccaccatctcactgtgtggaattcctgtgtccactggtcaccggggcacagaagtgctgtctcagcctgaatcgggccactgatgggacttgcagcctgggagctccaccgtgatctctggcccactttgcgggagtctaggctttctggatgctccaggcctcacgtcccagggcagttttcttccctgaagaaagttggatggcatgatctgtcttcccatcttgaaaccgtatggcaaattgtttttcagatgaattccctctgctgacaaccaaacgtgtgttctggaagggtgttttggaggagttgctgtggtttatcaaggtaaagaagtcgctgctattagaagtcagtagtctgttctcaacacagcagccagtgagatcctttcaaaactcaaagcagccaggtgtggtggctcacgcctgtaatcccaccgctttgggaggctgagtcagatcacctgaggttaggaatttgggaccagcctggccaacatggcgacaccccagtctctactaataacacaaaaaattagccaggtgtgctggtgcatgtctgtaatcccagctactcaggaggctgaggcatgagaattgctcacgaggcggaggttgtagtgagctgagatcgtggcactgtactccagcctggcgacagagggagaacccatgtcaaaaacaaaaaaagacaccaccaaaggtcaaagcatatcattcctcaccctcaagcccttagtggctccatttcactcagtaagagccacggtccttatggtgtccgtttttcagctctgaccttagctgctgctctctgcaccaccctgctgttcttgtgagtttttgagcacaccgggacatccccactccctggaaccttcttcccccacacttggcttcttcctttgagtctctactccactcgggcaagccttcctagacctcctgatttaaaactgtgactctcccccaacctccttggtgtttctccgtagacgaacatcaccatctgatgtatgtcagcctttcccttcccctgttagaagggggacagcaggtagtaaaagtgaaatgtgctgtaagctttatgagggcagaggatttgtttctcgtgttcactgttgtatcgccagggcctcaaacacagcctgccacatagtaggagtcaacatatattgatcactaaatgtagataccacctgtgttcccatgttcatataaattctagaagagtctcttcagtaacaaggtgaaccccttccagagggctgagtaggtacctcaggccggggccagagtgctgtgaagacagcagcagcccagaccaagcttctctgtgttccgtgtcctggtctagaaccagcgatgttctttctgaccagtgctttttggaaggtggctgaggtctgggctcaggtctgggccatactagaagctgggatcccttctatagagcacttggtatggcttgtatggtcttggggcaagccagacccaagccctcttatcccattttagaaagggcttcaatttggatccagccccaggtctgccttagctctgtattcttggggtattttgttctgtattggcctatcttgactaacaatgagccttggatttgaaacatatcatcagaaacctcagaagacaacattcttaaactggctagagcctggtctgaatggatgaaaaggagagacttttgaagcaatatgtaaaagattgagaaatgatttgttggaaatttctcaattggagaaatttctttgatttgttggaaatttctttgattctttctcaatcaaagaaaatcgggacaaactcaacaatagaaagggaggaagcaagatactcagaaataaaatgcattcccctgtttcaacttaatgcttcaattcaggattctaaggaatccttgccaggaatgtcagactcaccttgatagttggagttactccattggtgactcgatcaaatacaggagttgaggcacctgcactgtaaaatactgattagtctgatcattaggaatatcctgtatgccaggtagaagatacattgaacagattgcatgtaggcattaaattcattttggggtattacatatagacaacacatttcattaagaaacataaaactgtcagatcggtggaatacttaaaagcacttggaggtgtttagcctaaaaagcttagttgaggggaatggaagaaaagatctgggagggtggttccaaagaagggatcagactatcctaaagccctcaggaatctgggctgggaccacctacttaaagataggatgggcagctgggtgtggtggctcacgcctgtaatcccagcacttcgggaggccgaagcgggcggatcacctgaggtcaggagttcgaggccagcctgaccaacatggagaaacgctgtctctactaaaaatacaaaattagctgggtgtagtggcgcatgcctgtaatcccagctactcgggaggctgaggcaggggaatcgcttgaacctgggaggtggagggtgccgtgagccacgatcgcgccattgcactccagcctgggcaacaagagcgaaactctcaaaaaacaaaaaaaaggatgggttccatatgggtggtgtcaagtgcccacctcctagcaagtcagcaggggccagaggcccttgtaagtggtgtctcggggggatcaactgagatggcttaagatttacctggatgcctgctctgctctccccatctcttccagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcaggtgaggagatagaacaatgccttccatttccgggtgcccttcctagcacgtgtttgctccgttgttttagataaggtctgggggatgagtcaatgtcacaggagctgatgtatagctttgaccttgtgaggggtggtgccaggttgaagccacaattaacgcctactgaaggccgtttcacatcttttttttttttttttttttaattattatactttaagttttagggtacatgtgcacaatgtgcaggttagttacatatgtatacatgtgccatgctggtgcgctgcaccactaactcaccatctagcatcaggtatatctcccaatgctatccctcccccctcctcccaccccacaacatccccagagtgtgatgttccccttcctgtgtccatatgttctcgttgttcgattcccactatgagtgagaatatgcggtgtttggttttttgttcttgcgatagtttactgagaatgatgatttccatttcaccacgtccctacagaggacatgaactcatcattttttatggctgcatagtattccatggtgtatatgtgccacattttcttaatccagtctatcatgttggacatttgggttggttccaagtctttgcctattgtgaatagtgccacaataaacatacgtgtgcatgtgtctttatagcagcatgatttaatagtcctttgggtatatacccagtaatgggatggctgggtcaaatggtatttctagttctagatccccgaggaatcgccacactgacttccacaatggttgaactagtttacagtcccaccaacagtgtcaaagtgtcctatttctccacatcctctccagcacctgttgtttcctgactttttaatgattgccattctaactggtgtgagatggtatctcattgtggttttgatttgcgtttctctgatggccagtgatggtgagcattttttcatgtgttttttggctgcataaatgtcttcttttgagaagtgtctgttcatgtccttcgcccactttttgatggggttgtttttttcttataaatttgtttgagttcattgtagattctggatattagccctttgtcagatgagtaggttgcaaaaatgttctcccattttgtgggttgcctgttcactctgatggtagtttcttttgctgtgcagaagctctttagtttaattagatcccatttgtcaattttggcttttgttgccattgcttttggcataggcatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttttacatatggctagccagttttcccagcaccatttattacatagggaatcctttccccattgcttgtttttctcaggtttgtcaaagatcagatagttgtagatatgcggcgttatttctgagggctctgttctgttccattgatctatgtgtctgttttggtaccagtaccatactgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatggtcttccatttctttgtatcctcttttatttcattgagcagtggtttgtagttctccttgaagaggtccttcacatcccttttaaggtggattcctaggtattttattctctttgaagcaattgtgagtggaagttcactcatgatttggctctctgtttgtctgttattggtgtataagaatgcttgtgatttttgcagattgattttatatcctgagactttgctgaagctgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcactatgatattggctgtggctttgtcatagatagctcttattattttgaaatatgttccatcaatacctaatttattgagagtttttagcatgatgtgttgttgaattttgtcaaaggctttttctgcatctattgagataatcatgtggtttttgtctttggatctgtttatatgctggattacatttattgatttgcgtatattgaaccagccttgcatcctagggatgaagcccacatgatcatggtggataagctttttgatgtgctgctggattcggtttgccagtattttattgaggatttttgcatcaatgttcatcaaggatattggtctaaaattctcttttttggtgtgtctctgcccagctttggtatcaggatgatgttggcttcataaaatgagttagggaggattccctctttttctattgattggaatagtttcagaaggaatggtaccagttcctctttgtacctctggagaattcggctgtgaatccatctggtcctggactctctttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtaatctctgatggtagtttgtatttctgtgggatcggtggtgatatcccctttatcattttttattgcgtctatttgattcttctctttttctttattagtcttgctagcggtctataaattttgttgatcctttcaaaaaaccagctcctggattcattaattttttgaagggttttttgtgtctctatttccttcagttctgctctgattttagttatttcttgccttctgctagcttttgaatatgtttgctcttgcttttctagttcttttaattgtgatgttagggtgtcaattttggatctttcctgctttctcttgtgggcatttagtgctataaatttccctctacacactgctttgaatgtgtcccagaggttctggtatgttgtgtctttgttcttgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaactatgtggtcggttttggaataggtgtggtgtggtgctgaaaaaaatgtatattctgttgatttgggatggagttctgtagatgtctattaggtctgcttggtgcagagctgagttcaattcctgggtatccttgttgactttctgtctcgttgatctgtgtactgttgacagtgggtgttaaagtctcccattattaatgtgtggagtctaagtctctttgtaggtcactcagatgattggcacttactgggcgcttggcactttccatactgtgtcatcggcagatagctgcatggttggtgttcgtgctggggaatgggaagttcatcggtgggacaaggacaaaatgcccccattgctttgttgtggctttaatctccctttcgaggctgagccacagcgtgctgtaggtggcgctgctgtgaagcgcagtaccagggtcacactccactcccagctctgcagaggtggagaaagaatgaaacatctcactcctggacttccactttcctgtcactgttggtgtcacctcttactggatgtcacagagcccagcccctcccacctgtgcctaggaaaagcagatgccaccttggaatgtggggtttgtgtgtgcaatttactagctgggcagagaccagcaacctggagagcaggtgtctcgtctaaggggacagtcacatttcacctccagccacctggaggaatttgggcctggtgatgtcagaattcttcaataaaagcctaaaatctatattttatgtgcggtcatgagatctgttaaatgttagcaacttcaggaagtttaaaaatgctgtgtggacctagaataggcaagttcttaaaggcagaaagtggaatgctagtttccagggactggggaacagggaggaatggggagttcatgtttaatgggcacagaggttttgttagggatgacgaaaaagttcgggagatggtgatggtgatggagatggtgatggtgatggagatggtgatggtgatggtgatggtgatgggtgatggtgatggtgatggtgatggtgatggagatggtgatggtgatggtgatggagatggtgatggtgatggtgatggtgatggagatggtgatggtgatggagatggtgatggtgatggtgatggagatggtgatggtgatggtgatggtgatggtgatggtgatggtgatggagatggagatggtgatggtgatggttgcctaacatcaggaacgtgcttaatgcttctgaattgcacacaaaaatggcaagtttaatattatgtgtactttatcacaatgaaaaaagctgctgcgtgggccaagttacttgtgcaggtaatgttctgcaggtggttgcctgcacctcagttgtagggtgtccgtaggatgtgaggccagtccccgggcttaatgatgctttaaatcctgcctagtattcaattatttcttgtcgcttaaaaggcctaataaaattatggtcttagtttacagtggtatgaatgcttagctgttggattttagtaggaaagttcgtccctttttgtttttaattttgttttacagattcacaggaattttttttttttttttttttttttttttttaatgcacagaaagtttccctggactctctacccagtttccccagtgataatatcttgggtaacatcctgtatacattcacattggtgcattcctcagagttgtcagattttgctagttttacgtgcacttgtgtatgtgtgtatttgcaattttagcacgtgtagactcttgtaaccactacaatcaagttacagaactacactaccaaggttcatctttttaaaatctttgatgttaccttttttggaacagtgaccatgagaggactttcctcccaaaattttgaaaactactgaaccagaatatagtctgacactaataggtagaaatttaaccaaaggagattatgaagctctgcacttgagttaacaaaatcacttctcagcttccagttccatctcagaaggaaggaaaagggattaaaaatccagagaccagaaaatgggagcaaagtacaaggtggtgtaatcattacagaggtttcctgatgtttccaagtcagtcgtgtgttgagctgctaaactctaaagtaattttaggtggaatgttggaaacatgctgctgaggtgatagaaaggaatccatggtcctctgttagttggaaagtatatggaatactatattctacataagatacaatactctctgtgagacaaggataaagtagattttgtcagtgaaattgtgacaagaatcgctgatgggtttagagcctaagtttgcgaggagcactggaagaaattaagattgttgagattggaaagggttagctatgggggaacaggaggaggtgactccatgacagaccaaatattcaaaggactgtgtagaagaggaaaaagactttgttagggctccagaggacagagccaggagtcagacagggccttgaactcaacccaccgagatctgcaaactttgcaggatgcaccagatgtcttgtagccatgggtcaaggggggaccctgggtaagagactgtaatagatgacctctaaggccatctcatgacatgtgtgattaatgtatgtacctgtcctctctttttgacaattctacagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcactgagggaggcaggaccctgggcaacttcccccagccacatggttgtgtgacgttgggcaagtcacattttgctgcactttcaccttcagatcatgaggttgggcccagaggatttttttttttttttttttttttgagacagagttttgctctgttgcccaggctggaatgcaacggcgtgatcttggctcactgtaacctctgcctcctgggttcgagtgattctcctgcctcagcctccaagtagctgggattacagcatgtgccaccatgcctggctaattttgtatttttagtagagacgggttcacatgttggtcaggctggtcttgactcctgaccctcagatgatctgccttgcctcagcctcccaaccgagtgatcttaagttgtgtattatactcattcttacacaaaaagggctttaaatgcctagaaactacatgaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccacggaatttgaggctgtagtgagtcatgatcacgccattgcactccatcctgggcaacagagtgagaccctgaatatttaaaaacaacaacaacaacaaaactctatcaggatatcataagtacttagagtgaaatacttgcatctgtaatagagacttattttttttttttttgagacacagtctcaccctgttgcccaggctggagtgcagtggtttgatctccgctcacggcaacctccatctcccaggttcaagtgagttcccattcctcagccccagagctgggaccacaggcgcgcgaatttttgtatttttagcagagacggggtttcactatgttggccaggctagtctcaaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatttggtgccacgaggtagcccagatcccttcagctctgatggaagagcattgcttcagccgtaaatggacacctgcagaaaccttgcaccgatggatagtctccctcagctccgtgccatcgctgcaggggctgttatggacatcactgcagcccagtggctctctctcctggtctccaccatatgagttggcttctgtttctctcctgttttactttgcctttagctgtggtctttcaaaccaccatccctccttatcttcctctgctggttcctcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacatgagctcttcagttctttaatatgggaaaacaaattgcagagtttagtctctgattagcttttaaatttgatatgtgtaagtaagacatgaaccagcttttactttgaaaccttccttttctggaaggttttctggccctgtggtatatgcactaacagatctatacaggttgtttgtgatacagcttctatggatcttctcaaaagctatgctgaggttgggtatggtggctcatgcctgtaatcccagcactttggaagactgagacaggagcaattgcttgaggtctggagttcaataccagcctgggcaacataacaagatgctgttgctacaaaaaaatggaaaagctacactaaattatttttttaaaaaaagccttgcggtgtctgcatattctaatgtttttaaatgatgttttaaagaattgaaactaacatactgttctgctttctcccggtttatagccaggtgactttatacacactttgggagatgcacatatttacctgaatcacatcgagccactgaaaattcaggtaagaattagatgttatacttttgggtttggtaccttctcttgataaaaggttgactgtggaacaggtatctgctcaatgctgtgtccaagataaagatgactgctccaaatgtggggcttcagtttagggagaagtggtgggcaggtgggcaggacaaggcaggcatctgcctcagcaaccatggcacttaacttgtcaggtgctgtgaggtactaagcaccagtaccagagagggaagagccacattcaagccaggggattgtccaaaaggaggcattttaactcattttaacttgaaggagaattgaagtgcaaatgtttttccttttctttttttttgagatggagtctttctctgtcggccaggctggagtgtgccgtggtgcgatctcagctcactgcaacctccacctcccgggttcaagcaattcttctgcctcagcctcccaggtagctgggattacaggcacatgccaccacacccagctaattttttgtattattagtagagatggggtttcgtcatgttggccaggctgatctcaaactcctgacttcaagtgtaccacctgcctcagcctccgaaagttctggaattacaggcataagccaccaccctggccataaatattttttgttaattttacattaagtacaatatttaggtccaaacttcaaaagtctgttgaaatccctgaagttatagcagccaacaattgatatgaaatggcaataaaaatgtaagttcatctgcttcatgagccttaaggaaaaaaactcagaaccagacactttttagccccttccaggttagatccaggttttaaaagttattcctttgagggagtttggctgcttttgagtggaggtgacttcaggcttattctctctggctctctgctctggtcatttttagacatagtaataggttgtgacctgtcttcacatcctaattgccactgtctgttcatcccaggaatcctggctttcatccctttctgttcactgtccatgcatgtcatctttccttctttctgccagggaccagatgggttagggattgtgaattcaagtaaacgtagagctactatgagttacagattgactgtgttcctgtctttaataaatttgccaagagtggttataagaacttacacctgatgaggcaccaggctcctgatgctgtgtaatgtcacaaaatacccctcactctcgatctgtgcaagagaacagctggttgcgctccaatcatgttacataacctacgcgaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctatttttgtaagaacatcctcctggactttgggttagttaaatctaaacttatttaaggattaagtaggataacgtgcattgatttgctaaaagaatcaagtaataattacttagctgattcctgagggtggtatgacttctagctgaactcatcttgatcggtaggattttttaaatccatttttgtaaaactatttccaagaaattttaagccctttcacttcagaaagaaaaaagttgttggggctgagcacttaattttcttgagcaggaaggagtttcttccaaacttcaccatctggagactggtgtttctttacagattcctccttcatttctgttgagtagccgggatcctatcaaagaccaaaaaaatgagtcctgttaacaaccacctggaacaaaaacagattttatgcatttatgctgctccaagaaatgcttttacgtctaagccagaggcaattaattaatttttttttttttgacatggagtcactgtccgttgcccaggctgcagtgcagtggcgcaatcttggctcactgcaacctccacctcccaggttcaagtgattctcctgcctcagcctcccatgtagctgggatcacaggcacctgccaccatgcccggctaattttttgtattttttgtagagacagggtttcaccatgttggccaggctggtctcaaacacctgacctcaaatgatccacctgcctcagcctcccaaagtgttgggattacaggcgtaagccaccatgcccagccctgaattaatatttttaaaataagtttggagactgttggaaataatagggcagaggaacatattttactggctacttgccagagttagttaactcatcaaactctttgataatagtttgacctctgttggtgaaaatgagccatgatctcttgaacatgatcagaataaatgccccagccacacaattgtagtccaaactttttaggtcactaacttgctagatggtgccaggtttttttgcacaaggagtgcaaatgttaagatctccactagtgaggaaaggctagtattacagaagccttgtcagaggcaattgaacctccaagccctggccctcaggcctgaggattttgatacagacaaactgaagaaccgtttgttagtggatattgcaaacaaacaggagtcaaagcttggtgctccacagtctagttcacgagacaggcgtggcagtggctggcagcatctcttctcacaggggccctcaggcacagcttaccttgggaggcatgtaggaagcccgctggatcatcacgggatacttgaaatgctcatgcaggtggtcaacatactcacacaccctaggaggagggaatcagatcggggcaatgatgcctgaagtcagattattcacgtggtgctaacttaaagcagaaggagcgagtaccactcaattgacagtgttggccaaggcttagctgtgttaccatgcgtttctaggcaagtccctaaacctctgtgcctcaggtccttttcttctaaaatatagcaatgtgaggtggggactttgatgacatgaacacacgaagtccctctgagaggttttgtggtgccctttaaaagggatcaattcagactctgtaaatatccagaattatttgggttcctctggtcaaaagtcagatgaatagattaaaatcaccacattttgtgatctatttttcaagaagcgtttgtattttttcatatggctgcagcagctgccaggggcttggggtttttttggcaggtagggttgggagg

SEQ ID NO: 1591 - DNA, 1603 bp, Homo sapiens
  Genbank Accession No. D00632
ggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtcctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctagatcaaccaaggcagatgtgacaagcaagggccacggaccccataggcaggggtggcgtcttcatgagggaggggcccaaagcccttgtgggcggacctcccctgagcctgtctgaggggccagcccttagtgcattcaggctaaggcccctgggcagggatgccaccctgctccttcggaggacgtgccctcacccctcactggtccactggcttgagactcaccccgtctgcccagtaaaagcctttctgcagcaaaaaaccccc

SEQ ID NO: 1592 - DNA, 1192 bp, Homo sapiens
  Genbank Accession No. D00723
ggctccctccggccgcgaactgcccctccccgccccgcctcccggcgcgggtggccgaggcgtagcgccgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactatattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgaagccagcagagttgtcttaaattagtggtggatagagacttagaatagaaacttttagtattaccgatggggcaaaaaaaaactactgttaacactgctaatgaaagaaaatgccctttaactttgtaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaaaaaaaaaaaaaaaaaaaaaaaaaaaaaaaaaaaaaaa

SEQ ID NO: 1593 - DNA, 3634 bp, Homo sapiens
  Genbank Accession No. D10040
tcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacaccgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgcttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttc

SEQ ID NO: 1594 - DNA, 409 bp, Homo sapiens
  Genbank Accession No. D10511
attttggttagtcataaattctgtacttcattaaagaagtaaatgctttcttaattttaggatgtctggagccaggattgttggtcatttgactcatgccttgaagcaaggagaatacggtcttgccagtttttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacattttt

SEQ ID NO: 1595 - DNA, 1451 bp, Homo sapiens
  Genbank Accession No. D11086
gaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatc

SEQ ID NO: 1596 - DNA, 123 bp, Homo sapiens
  Genbank Accession No. D11756
gatctgaaaaagaacactgtgcgagattgtattcctgcttatcctttccaagttagtaggcagattggaactatagaatttatccgtgataataataaagtccgcataacttttgtcctgaaa

SEQ ID NO: 1597 - DNA, 494 bp, Homo sapiens
  Genbank Accession No. D11802
  unsure (1)..(494): n = a or c or g or t
gatcaaagnngcactgccctgcacttcctnggccgcgtggccaacccgntnagcacagnatgagggccagggccccagaacacagtgcctggcaagnctctgcccctggcctttnaggcaaaggccagcagcagataacaaccccggacaaatcagcgatgtgtcacccccagtntcccaccttnnntttctaatgagtcgactttnagctggaaagcagccgtttctccttggtctaagtgtgctgcatggagtgagcagtagaagcctgcagcggcacaantgcacctnccagtttgctngggtttattttagagaatgggggtggggaggcaagaaccagtgtttagcgcgggactactgttccaaaaagaattccaaccgaccagctttgttttgtgaacaaaaaaggngttccttttttcaagtttgaggaccaaaaatttggggntttttaaaaattaaagnnttccanttttttgcaattgcccaaa

SEQ ID NO: 1598 - DNA, 156 bp, Homo sapiens
  Genbank Accession No. D11835
  unsure (1)..(156): n = a or c or g or t
gatcttgttcacaagtnaatctgttgacagtgccaattaaatgataataaaaaaattaacatgtcacaatgtaacggatgaccatatgcacaattccatgaattaaatctgtttcctgtgttagtcagtattcttaaataaaatttataattgaaa

SEQ ID NO: 1599 - DNA, 133 bp, Homo sapiens
  Genbank Accession No. D11881
gatcttaagcgtgtcttgagttccatgcaaattcaattctgttgataatgtgtccataatcaaatcatcatcttgcaatgcaagggctaccccataattatcagacattaaaatagtttatttctttttcaaa

SEQ ID NO: 1600 - DNA, 3493 bp, Homo sapiens
  Genbank Accession No. D12485
agcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtattt

SEQ ID NO: 1601 - DNA, 2073 bp, Homo sapiens
  Genbank Accession No. D12620
tggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctacagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgacgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtacaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatggaaatttccaagaaacagggccaatctgaagagatgtatagtggattggtgcgtttcagcagctggggggggggggggg

SEQ ID NO: 1602 - DNA, 910 bp, Homo sapiens
  Genbank Accession No. D13243
cctccgccaggaaagctccgtggcttcctccgtgttggagacctggtgattgtggtgacaggctggcgacctggctccggctacaccaacatcatgagggtgctaagcatatcctgagacgcccctcccccctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattctctgcatccaatctgctcagcaggccctaagatgccttgagtctttaatcccaggtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaactcgtgctgggcttgtagaccactgtcctggctgctctcatgcctgcctgataccctgcttggtcaaatcccggctgcttccttctgcacccagaaattccttcccactcatgttgttcccacacacaaaccaagagccaaaaatgagtgtgtctattttatatttaaacccatctgtttggaagcaattataaaacttctcccacacaccaagaa

SEQ ID NO: 1603 - DNA, 3730 bp, Homo sapiens
  Genbank Accession No. D13370
aaacagaatatttcgagtccatctctattatactgtttatcatgctgtagtataaacatctatttatatgtctgactccacagcagtataacatctatttctgaatacttagcacataaaatgcgctcagtaaaaggtaaatgaactcatcagatccacgtccaagtgcctgtaactcttctagtcatcagccttgtgacgttaataatgtcacataatttcaatgagactcggatcgaaagctgcacctcactagtatttaggaagatggaaggctgattctgtgcggggaagtgcgcggaaaactcttaagtcccctactcaccaacctgtgccaggaggcgtgacgtaagtccgccgcgggttcgccagcaccttgccatcccgcaccacgcccacgccaatcttattggcgctgccttcaaaacccagcaccgccggcatggcggaggctgggagaaaacgccgacaggactcctggcaatgtcaggagctgtggaggtcctcactagtccgcgctgggccgcagctttccggagcgcagaggaagctggccagcctgcagatagcactgggaaagacaccgcggaactccagcgagcggagacacgccaaggcccctccagggacctgtcttcctaactgccagggacgccgagccaactctgtgccttacattcgtatccgttttcctatctctttcccgtggtccagcccagccttctccactgtttttttccctcttgcacagagttagaatcttaagtcagtgtcacacaatgtgctgtgcatctggcacaacgataaacagcccgagggagggttggggacctaagtgtcctagagaattagaggagggaggcgaggctaagcgtctccgtcacgtggtgtcagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagatgtgagtggaatttgagggaaagagacattttttagtattgaatggtcttagggtttagtcaccccttttctccgtttagccttcaggctgttttatttttctcctgcccgtagttttctgtggggcttccccagtcttgccagttgtatttcctaaatgtctgttccttcacttccattgccattttcttttttagtgttctctcctcttcccagaatgttgcaaaaacctcttcactatacttcctccattttatcttcctgcattgcattccatatgaagcatgtcctccattccattaaccatagcttaaaaatcttagcttgctatccactgcctatagaaaaaacacatctccttggcatagcatgtaagactttcttacctctctatatttgttttcatttatctagcttagaattgtttgaatattgtgctgcttgactcgaactccttaggccaagagactgtttaacccgtgcgtatctatgacttagcatatagattattcaataaatgttctgctgaattgataatacgttttccacctttcttttcacttacagtgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggtgagaccctattgatgcctaatgcctgaactcttcaaaaccaattgctaattctctatctctgccccacctcttgattgctttcccttttcttatagttttttatgctaattctgtttcatttctataggcgaggaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagccttgctgtcttcgtgtcttaccccttcgtggggctacacattctcttcctcatattttcatgcacacaagttaacaagtgaaaagcgtagagtcatgaccttatttatttacaagcacaggataagtccctaacctcccccaaagactgagcaaccctacccagcccagttaaatactgcaactgggggggtaaaaaagg

SEQ ID NO: 1604 - DNA, 684 bp, Homo sapiens
  Genbank Accession No. D13413
cctttttgtcccagttgtcattattttcgaattcctaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgtgaagcctgtgaaagtttcagctccccgagttggtggaaaacgctaaactggcagattagatttttaaataaag

SEQ ID NO: 1605 - DNA, 917 bp, Homo sapiens
  Genbank Accession No. D13435
aggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataat

SEQ ID NO: 1606 - DNA, 3594 bp, Homo sapiens
  Genbank Accession No. D13636
aggactttggcgagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttc

SEQ ID NO: 1607 - DNA, 6478 bp, Homo sapiens
  Genbank Accession No. D13639
agagcgagcaggggagagcgagaccagttttaaggggaggaccggtgcgagtaaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagactttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccatctgatggcacagaaggatcttaattcccatctctatacttctcctttggacatggaaagaaaagttattgctggtgcaaagatagatggctgaacatcagggtgtggcattttgttcccttttccgttttttttttttttattgttgttgttaattttattgcaaagttgtattcagcgtacttgaatttttcttcctctccacttcttagaggcattcagttagcaaagaggttggagcaacaactttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattcttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattttgaagttttggagagggaagtggagcagccagcaagtaagctagccagagttttctcaagagccagctttgctcagcacactctcctgggccccaaggagtcccacggaatggggaaagtgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 1608 - DNA, 5134 bp, Homo sapiens
  Genbank Accession No. D13640
ggacacggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtgttgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaagtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggtttgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctcaggacaggatgactgtcttccctattcttagggacaagtcccaagatgccagaaaggcagtctcccaaggacccaccatgcagaagtgtcaataaaccacaagttctg

SEQ ID NO: 1609 - DNA, 4187 bp, Homo sapiens
  Genbank Accession No. D13643
ggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 1610 - DNA, 1763 bp, Homo sapiens
  Genbank Accession No. D13705
agagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctgtcccatcagcacacgagacccaaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcattgggaaacaatttgccatgaacgagctgaaggttggccagcaggccctgaccctcgtccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccatacacctgtctccttcttcctgcctgcttgtctgttcctatattagtttcctattactgctgtaataaactatcacaatctcagtgatttt

SEQ ID NO: 1611 - DNA, 1563 bp, Homo sapiens
  Genbank Accession No. D13814
aggtaccttgacaggcagcagcgaagtgaacaggacgtcatggaccgtcgcgccgctagctagctacttcgggccgtggcggtgatcgatggcgagcggctgatgcggaccctcgacgttaagggcgagagcctgacgcgaggcggcggtgcggtagacccgacatagagcgcctgtctgggacgtacgacgccgtgccgctcttattatatagtgtttgacaatcgaccaggtgatcaatgatcctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgttcctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgccttccattatgagtcccgaaattcaaccctcccgatagggctgggcctgaccaaaaatatactgggttcctgtttcccttttctgatcattcttacaagttatactcttatttggaaggccctaaagaaggcttatgaaattcagaagaacaacccaagaaatgatgatatttttaggataattatggcaattgtgcttttctttttcttttcctggattccccaccaaatattcacttttctggatgtattgattcaacagggcatcatacgtgactgtagaattgcagatattgtggacacggccatgcccatcaccatttggatagcttattttaacaattgcctgaatcctctgttttatggctttctgggaaaaaaatttaaaaaagatattctccagcttctgaaatatattcccccaaaggccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagccttagctacttttcagaattgaaggagaaatgcattatgtggactgaaccgacttttctaaagctctgaacaaaagcttttctttccttttgcaacaagacaaagcaaagccacattttgcattagacagatgacggctgctcgaagaacaatgtcaga

SEQ ID NO: 1612 - DNA, 2036 bp, Homo sapiens
  Genbank Accession No. D14012
gccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaag

SEQ ID NO: 1613 - DNA, 1301 bp, Homo sapiens
  Genbank Accession No. D14520
gggcacgcgcaccaccgcccgcagcgcagcccgcgcccgcgcaggccccgcagccggcccagcccgccgccaccggccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaccc

SEQ ID NO: 1614 - DNA, 488 bp, Homo sapiens
  Genbank Accession No. D14530
tggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 1615 - DNA, 836 bp, Homo sapiens
  Genbank Accession No. D14657
gtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaatt

SEQ ID NO: 1616 - DNA, 3694 bp, Homo sapiens
  Genbank Accession No. D14664
gctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttgtgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaatatggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcag

SEQ ID NO: 1617 - DNA, 1311 bp, Homo sapiens
  Genbank Accession No. D14686
acctcctgtggccagggcttctatgggctgtggcttatgtctcatgtgtcattctccagggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtaggtggaccagggaagctgggaaacccttgtctcttcccaggagggtgggggcactggcagggtggtgctgatgcgtggcttatgcttgcttgacaggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctkcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgccagtctctagcttcattgttctctgttcacagggttcctgaaatgccaacccaatgcc

SEQ ID NO: 1618 - DNA, 1860 bp, Homo sapiens
  Genbank Accession No. D14695
cgtgaacggtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtgtttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtaagatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 1619 - DNA, 1584 bp, Homo sapiens
  Genbank Accession No. D16294
gcgtcccccacaccacagacccgcgccgccgacgacccagcagccgccatgcgtctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttactgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttc

SEQ ID NO: 1620 - DNA, 1875 bp, Homo sapiens
  Genbank Accession No. D16350
tgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccgagatggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtgcaacaagtggatatccgaaaatgtctgcacacacccacagcagttttggtttaggtttatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagagcatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactgtcagtgggaagacaaaaagaaatgaactgaggaagaaagaatggaagacaatttaaagttgtttcattaattaccatatctataaacaaacatagtatctgtcaatctctagagcggccgccaccgcggtggagctccaattc

SEQ ID NO: 1621 - DNA, 1991 bp, Homo sapiens
  Genbank Accession No. D16481
cttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggaaaaaaaaa

SEQ ID NO: 1622 - DNA, 3085 bp, Homo sapiens
  Genbank Accession No. D16626
agcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataag

SEQ ID NO: 1623 - DNA, 228 bp, Homo sapiens
  Genbank Accession No. D19737
  unsure (1)..(228): n = a or c or g or t
gatccggagggaaatgtgttagagggtctggaaaattcagtgcttttnagttacttgtttttattaaaaatttcctcacaaaagngagtcctcaagtngtggctgtncttgggaaaggggncaccgtgtctgacaaagtgtaactttaaaaagcacgttgattttttacaaatgtaagtgtgcttgggaattccttaaattttgtgcaataaactattttttggtaaa

SEQ ID NO: 1624 - DNA, 202 bp, Homo sapiens
  Genbank Accession No. D20350
  unsure (1)..(202): n = a or c or g or t
gatcgctcttgtgtttttgcactattaattaacttcaagtgcaattttggcaggcaggccaagggtctcaacaggctatttggaatgagttctcttttaaggccttcaacgtagtnngacattttcaaatcaaaaagtacagcaggagccagcctttattttgtctgtgtacacaataaaatattccgcttctataggcaaa

SEQ ID NO: 1625 - DNA, 145 bp, Homo sapiens
  Genbank Accession No. D20464
gatcagattttttttgtacctacgtaagagtacttgaagttttatttaaaataaaatgttgtggaaaaggtagcattctttttttaggagtgttatttttcactatgtgtggcacggatacaataaaagacttttacaaactaaa

SEQ ID NO: 1626 - DNA, 161 bp, Homo sapiens
  Genbank Accession No. D20899
gatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaa

SEQ ID NO: 1627 - DNA, 152 bp, Homo sapiens
  Genbank Accession No. D20906
  unsure (1)..(152): n = a or c or g or t
gatctagaagttttacntttataaagatggtgtccggaagatgttgctaatgtattttacttcaagatagggaacaaactttttaagtatattaataaacctgtatggttagtttttaacagttttttaaaataaactatggatatgacaaa

SEQ ID NO: 1628 - DNA, 3406 bp, Homo sapiens
  Genbank Accession No. D21063
ctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatat

SEQ ID NO: 1629 - DNA, 1360 bp, Homo sapiens
  Genbank Accession No. D21261
gcccttgccttgagtcagtgcgctgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcagataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttg

SEQ ID NO: 1630 - DNA, 1418 bp, Homo sapiens
  Genbank Accession No. D23660
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggc

SEQ ID NO: 1631 - DNA, 5323 bp, Homo sapiens
  Genbank Accession No. D25216
cggggctggaggcggtggctgcggttgcgggaccggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagctttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtatcccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgctgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagttcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgac

SEQ ID NO: 1632 - DNA, 1232 bp, Homo sapiens
  Genbank Accession No. D25274
tcttgttcagattaagagttgccaaaataccttctgaactacactgcattgttgtgccgagaacaccgagcactgaacttagcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttggawtcat

SEQ ID NO: 1633 - DNA, 2591 bp, Homo sapiens
  Genbank Accession No. D25328
cccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaa

SEQ ID NO: 1634 - DNA, 108 bp, Homo sapiens
  Genbank Accession No. D25560
gatctgacgttttctacgtagcttttgtattttttttttaaatttgaagaaacactgatgaagccctgccatacccctcccgagtctaataaaacgtataatcacaaa

SEQ ID NO: 1635 - DNA, 1620 bp, Homo sapiens
  Genbank Accession No. D26129
gaattccgggtttgaaaaggagttctagggaagaagagagttagttagcacatcaatgggagcagggctcttaccccacgtggtgttacatatatattattttcatacatggtttctggctcataagttccttagcccttgctatagtcttttgtgttcggtcttaagggcaggactgtactcttccctcacctttctaattgtgcatcttaagaccttccccagagagggtggtgccctgtagttgtgggaaggaatgctggcatcatgaagcttccataaaaacccgagaaacgagcttctggatagctggacacatggaggtcctggagggtggagcccagggaggcatggaagctccacagcccttcccccataccttaccctatttcctctgtatcctttgtaatatcctttatgataaaccagcaaatgtgtgtaaatgtttccctaaggtctgtggccactccagcaaattaattgaacctaaagagggggtcgtgggaaccccaacttgaagccagtcagtcagaagttctggatgtccagacttcagactggtgtctgaaagggtggaggcagtcttggggaccgagcccccaatctatgggatctgacactatctccagtagtgttggaattgagtcaccagcgtgtccactggttagtgtgtgagaaactccctaccattggtcacagaagtcttcttctgtgttgatagttgtagtgtgacagcagaggaaaaacaaagtcagaaagagttttcccgaacacacccaatttctccattttactatccatttccacaaacactgactacaatagaagtataaaaattactccactgcatcattcagctttccatctctctcagacaccaagctgcagatccaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagccggaattc

SEQ ID NO: 1636 - DNA, 1929 bp, Homo sapiens
  Genbank Accession No. D28124
acccccgcacccagctccgcagaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagagggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattcttcggaatt

SEQ ID NO: 1637 - DNA, 792 bp, Homo sapiens
  Genbank Accession No. D28589
ggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctgac

SEQ ID NO: 1638 - DNA, 328 bp, Homo sapiens
  Genbank Accession No. D30946
  unsure (1)..(328): n = a or c or g or t
cagctccgccatggctcctaaaggcagctccaaacagcagtctgaggaggacctgctcctgcagnatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaa

SEQ ID NO: 1639 - DNA, 350 bp, Homo sapiens
  Genbank Accession No. D31094
  unsure (1)..(350): n = a or c or g or t
gctcgtgggttggcagtatgagagttgtaatggcccgactgttgagtgagggggagcaggggatcccaacggcttgcgctgcctttgcgcanagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaagcgggcttttgccatgttgtccaggctggtctctactt

SEQ ID NO: 1640 - DNA, 311 bp, Homo sapiens
  Genbank Accession No. D31117
  unsure (1)..(311): n = a or c or g or t
aagaattggagaagctccgcacagccggccccctagagtcttcagaaacagaggaggcctcacagctgaaggagagactagaaaaagagaagaagttaacaagtgacctggggcgcgccgccacgagactgcaggagcttctnaagacgacccaggagcagctggcaagggngaaggacacggtgaagaagctgcaggaacagctggaaaaggcagaggacggcagcagctcaaaggagggcacctctgtctgagtttcctctttggaaaaagaagttactgttcaacttaccaaaatgccttacacattc

SEQ ID NO: 1641 - DNA, 360 bp, Homo sapiens
  Genbank Accession No. D31225
  unsure (1)..(360): n = a or c or g or t
cccagttgcacactggcattttcttgctgcaagttnttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactggggttcttggggtcttcaggactgaagaggagggagagtggggt

SEQ ID NO: 1642 - DNA, 281 bp, Homo sapiens
  Genbank Accession No. D31289
ttgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggctgaccatctttgtgctgtctgtcgtcactatcatcatctgcttcacctgctcctgctgctgcctttacaagacgtgccgccgaccacgtccggttgtcaccaccaccacatccaccactg

SEQ ID NO: 1643 - DNA, 311 bp, Homo sapiens
  Genbank Accession No. D31294
  unsure (1)..(311): n = a or c or g or t
gcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccntacccacctcctcaagggtacccntaccaaggatacccacagtacggctggcagggtggacctcaggagcctnntaaaaccacagtgtatgtggtaggaagaccaaaggaagagatgagctag

SEQ ID NO: 1644 - DNA, 332 bp, Homo sapiens
  Genbank Accession No. D31381
  unsure (1)..(332): n = a or c or g or t
ctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgactataagcnactgcagaccttccctctggtcaggcactcggacatgccagaggagatgcgcgtggagaccatggngctatgtgtcacagcctgt

SEQ ID NO: 1645 - DNA, 321 bp, Homo sapiens
  Genbank Accession No. D31417
  unsure (1)..(321): n = a or c or g or t
atgangcattgctccccgtatgtaataccctcccacccccacgccccccccacagcagtgtctcttaagccatttgtccattatttggtttgttgagatatcttttctcttgcattagggatgtgggaggcaaggcagggatggagaaaggccagtgccaaacactatccacttaaccccatctcctgtctttcttgggcttttctccccaagacgggtctcacggccaaggaactggaggccctggatgaggtcttcaccaaagtgtacaaagccaaataccccatcgtcggctacactgcccggagaattctcaatgag

SEQ ID NO: 1646 - DNA, 3687 bp, Homo sapiens
  Genbank Accession No. D31628
acctccacctggctaggggagttgaacttggaggccgaaggctgacctcagctttgctctgaaacagattcgccacttgagagagagaggcctggagttcttatctgttccctccacgtactcattaagtgtggcctgagtagaatagcccggtcatgttcagttcttcctcgcgctgctgacctcatggcctagaagtctctgtcccaatgaattataaccaaactgagagtgtcctgtgtgccaggtctgttccaaagagcggtgcttatctcctttaatcccacccacactattctcgttccagtttacaaatgaggctcaaaggratatggtgattttcccaagtcacactgtatgtaacagagccaggatgcaaaccttctccggccgtgcctctcagagctatggaatacaacgctgtgacgcaaacaggactttggggccagtctccaaatgccccctcaaatttcctctaggcaagagttctggagccgccactgractccagccggccttggcttctgagctttggattctgggcagtaatggtcacattcccagcgtcctggaaaagcttgcccttggcttctggccctgactctgcctcccactgactagtggacgtcaactgcccctctctgggcctggcaacaccatcctgttcaatgaggctgcggctggatcagaggtccccaggcctggaaccttccagggctgggctcagctcccccaacccccatccccccaggtaggccaggaggctgggcgggacctgcttggggttaaatactccggcccagcactccccaggcctctagtcccagtaggaggtttgactaagatcaatcatggtaagtgccatggccatctccccttgggtgggacatcttcagtaacgcttccagaagcaccttgtgttggaacctccaagtctcactgtccttctttttctccttagacgacttacagtgacaaaggggcaaaggtaagcaggcgaaatgttgggaaatgtagggcacctcacctcttctctccttctgcagcctgagagaggccgattcctccacttccactctgtgaccttctgggttggcaacgccaagcaggtagaagccggggcaaggtgctggagtgagcagacggcagggcagagggctgcctgacaagggcaggcctccagcagggtctgtgattggcccttgggagggaggatcaggccaggggtgggccagatactctgaatcctaattacaccagcgggaaagttatctgtcagcaaaatgtgcaggcagcagtctatcttcccaggagggtctctgcccctgaggcaatagggcaggcaggctgaggggggccaggggctctcttgcggaagtcccccatgctggccccttgaccctcatgaaccctgctgcaaccctgtgattcaggccgcgtcattctactgcagcaagatgggctttgaacctctagcctacaggggcctggagaccggttcccgggaggtggtcagccatgtaatcaaacaagggaaggtgagtcaccacccccaggacactgggccactagcctcacctccttctcctatcttagattgtgtttgtcctctcctcagcgctcaacccctggaacaaaggtggaggtgcccggggagggtggacgcatggctctgtgggtgggatctgggttctggagggtggcgctaggctccgtgggtgggctctgggttcaggcctggatggagactaaaagccaggtgaggggacctagactccagactccagtgccatcctctccctgccggccacagagatgggcgatcacctggtgaaacacggtgacggagtgaaggacattgcgttcgaggtggaagattgtgactacatcgtgcaggtaagaaagcacctggagaaactggaggggcctgcagaaagcacgggaacggggcgccaaaatcatgcgggagccctgggtagagcaagacaagtttgggaaggtgaagtttgctgtgctgcagacggtgagttccctttggtgcccccacccctcctgctgtcggcaccactgccgagccaggctgttttccacccgtagtatggggacaccacacacaccctggtggagaagatgaactacatcggccaattcttgcctggatatgaggccccagcgttcatggaccccctacttcctaaactgtgagtgtccctcagggcagaggtgggtggaaagccttctcacccccatcttcttcccttcccaggcccaaatgcagtctggagatgatcgaccacattgtgggaaaccagcctgatcaggagatggtgtccgcctccgaatggtgagaccttgcccctctccctctgcgtgaagagcatatgtgttccaccgcccaccctacaggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggtgaggccggccctggctggggragaggggcgcagggaagaggtctgggggctcttgtagggtcagggatgtgggtgatggggcaaatgacagtggtctccttgtttccctcccccaggaatatgtggactataacgggggcgctggggtccagcacatcgctctcaagaccgaagacatcatcacagcggttagaacccccttgcctgtgcgaattcctctctcatggaggccgaaggctgacctcagctttgctctgaaacagattcgccacttgagagagagaggcctggagttcttatctgttccctccacgtactacaaacaactgcgggagaagctgaagacggccaagatcaaggtgaaggagaacattgatgccctggaggtgaggcccaggcaggatccctcgagggatctcaccgtgcagttcccctagcagagcccctgtttcccgcctaggagctgaaaatcctggtggactacgacgagaaaggctacctcctgcagatcttcaccaaaccggtgcaggaccggcccacgctcttcctggaagtcatccagcgccacaaccaccaggtactgcttgtccccggcaggcccgaggggacaggcagctagcacactcggttttctgggtcctttgggtcatctcctctctttcccgccacagggttttggagccggcaacttcaactcactgttcaaggctttcgaggaggagcagaacctgcggggtaacctcaccaacatggagaccaatggggtggtgcccgggatgtaagcccccgcccaccccacggaggccacagccacacagccacgccccctgattctggaactcgcccaacttccctactggctgctccccttgggtcccgcccaccagcggactcggcccccaaggctccgcccacactgaccacgggcctcggcggggccgccctctgctccagccctcccgattaaagcgtgctccggtccaatactgtgtctgtgtttgtgttgcgcataaggcagtagtgcttatggcagccagggggaggccaggcaggccgccagcgccgcggcgaccgaggagctgcgggtgcgcagcgctttgccagcgggaccacgcg

SEQ ID NO: 1647 - DNA, 4859 bp, Homo sapiens
  Genbank Accession No. D31716
cacgttgggtgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaagccgttctgactggcagggggagaaagtaaacagagttgaatcaccctccccactggccaattggagggggtttggtttgtgacgtgatgggattctgcgaaattgttactgagcaagagaatgccggaacgtgcggaccggccggagcaggggttcagaagccgtcagtggactcgggaaaaagtgtctcttagacctggcgctcggcggggccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgggcgggcgggtcgtcgtccgaggccagggagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggcccttcccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactgggtagattttaaagattcaacactggtgtacatatgtccgctgggtgagttgacctgtggcctcgcacagtgattctaggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatgcgcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagtgttattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacatttacttcccaaaaaagttgttacttgccttttcaagtgtgacaaactcacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctctt

SEQ ID NO: 1648 - DNA, 1356 bp, Homo sapiens
  Genbank Accession No. D31815
acaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatg

SEQ ID NO: 1649 - DNA, 4573 bp, Homo sapiens
  Genbank Accession No. D31887
cgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccacaatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagcagaaattagaaaagaaaattaacttatgtggactgtaaatgttttatttgtaagattctataaataaagctatattctgt

SEQ ID NO: 1650 - DNA, 996 bp, Homo sapiens
  Genbank Accession No. D37931
gaattccggcccccctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagtctctcagatcctatcctgtggaatttagttattatgtgtatttatgtagtatttcaaacatttcaaaatgctttcatctatgtttatcacattttaataccacagacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttccggaattc

SEQ ID NO: 1651 - DNA, 3071 bp, Homo sapiens
  Genbank Accession No. D38073
gaagttttcgcgccgcggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaacgctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgaccaaagtctttgcctctactcccttaacagtgttgaattcaactgaagccgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtac

SEQ ID NO: 1652 - DNA, 1206 bp, Homo sapiens
  Genbank Accession No. D38305
gttgctgtcggggagttgaaacctaattttgtggcgtagagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttttaagcttatagtaaggatacattcaagcttgggttaaaaa

SEQ ID NO: 1653 - DNA, 881 bp, Homo sapiens
  Genbank Accession No. D38491
gtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctggtatgtttcattcccccgtaaaattacataatattaaaatttattgcatttaaatcagatgaacttattgctgttagtgagatggtgaagcactttaaccttttgaatcaataggttcaaatttaacccaagaaaagagttgctcttactatctactgctgactcttgaactttttaaataatgtattgagtttacttaataaaatgatactcttgct

SEQ ID NO: 1654 - DNA, 3058 bp, Homo sapiens
  Genbank Accession No. D38535
gccccacagtgagaggaaggaaggcaacagtcgccagcagccgatgtgaagaccggactccgtgcgcccctcgccgcctctgcctggccacatcgatgttgtgtccgccgcctgctcgcccggatcacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctga

SEQ ID NO: 1655 - DNA, 5253 bp, Homo sapiens
  Genbank Accession No. D38548
gtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgatgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctaaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaattaaacccaagagtttgattat

SEQ ID NO: 1656 - DNA, 595 bp, Homo sapiens
  Genbank Accession No. D38583
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 1657 - DNA, 4664 bp, Homo sapiens
  Genbank Accession No. D42040
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttccggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgctgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgagggaaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtccccaaatggagcggaagg

SEQ ID NO: 1658 - DNA, 2681 bp, Homo sapiens
  Genbank Accession No. D42085
cggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgctttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 1659 - DNA, 3186 bp, Homo sapiens
  Genbank Accession No. D43949
aggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcgacccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtgctggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatattttt

SEQ ID NO: 1660 - DNA, 1938 bp, Homo sapiens
  Genbank Accession No. D43950
attccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattg

SEQ ID NO: 1661 - DNA, 1479 bp, Homo sapiens
  Genbank Accession No. D45288
cgtggacctagggattctgcaggaattcggcacgaggtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccaaatgcagatctgaattataagatgtttatgtttgaccattgtttcaacaatgggattttgttacggaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtggggcagtttcagaaaagaaacaaacaaacaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatastgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaaaaaaaaaaaaaaa

SEQ ID NO: 1662 - DNA, 268 bp, Homo sapiens
  Genbank Accession No. D45529
  unsure (1)..(268): n = a or c or g or t
gatcttttgtgtctggttcctttcacgttgaacgctatttttaaggttcgtgcctgttgtagaccacagtcacacactgctgtagtcttaccccatcctcattcccagctgcctcctcctactgtttccctctatcannnngcctccttggcgcaggttccctgagctgtgggattctgcactggtgctttggattccctgatatgttccttcaaatccactgagnattaaataaacatcgntaaaagaatgaccttcccaaggnaaa

SEQ ID NO: 1663 - DNA, 232 bp, Homo sapiens
  Genbank Accession No. D45556
  unsure (1)..(232): n = a or c or g or t
gatctctgaaaagnaggtttcagccacgaggcagctgntcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccagaaa

SEQ ID NO: 1664 - DNA, 109 bp, Homo sapiens
  Genbank Accession No. D45714
gatctttttaactctactgtgtcattaagatgctttgtacaatgccaaaccatagttggagaaactaagtttaataaatatcaaatagattttctgtattaaagttaaa

SEQ ID NO: 1665 - DNA, 1487 bp, Homo sapiens
  Genbank Accession No. D49357
gtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgccaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatgcggcctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggacttggatttgaagaagcccatctaccagaagacagcatgctacggccatttcggaagaagcgagttcccatgggaggttcccaggaagcttgtattttagagccagggggagctgggcctggtctcaccctggaggcaactggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaag

SEQ ID NO: 1666 - DNA, 966 bp, Homo sapiens
  Genbank Accession No. D49387
ggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccccgg

SEQ ID NO: 1667 - DNA, 680 bp, Homo sapiens
  Genbank Accession No. D49400
agtttcagtggcttctggtgctctagggtgagctctgcccggctgcagggatggcggggaggggtaagctcaccgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccag

SEQ ID NO: 1668 - DNA, 3008 bp, Homo sapiens
  Genbank Accession No. D49742
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccatgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaagccctgcaggaagtttaacctacgtgtcatctgcctggtcatctcagacccatgaaattaggcgccttgtttgagctgcgtttcacacttctttagacgctagctgacctttggccaaaaataaactttgaaaag

SEQ ID NO: 1669 - DNA, 1747 bp, Homo sapiens
  Genbank Accession No. D50312
cctctagccctccctgcgtttagattcagttgcaccttttattattttaactcttctccttaggacacgcagcccccaatttgtccctccgcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgttt

SEQ ID NO: 1670 - DNA, 1635 bp, Homo sapiens
  Genbank Accession No. D50582
ctgaggctggtattaagaagtgaagtgggacccaggtggaggtaaggaagagtctggtggggagttatctcagaagtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatacgtgctgacacgcctggcagaggaccctgccgagcccaggtaccgtgcccgccagcggagggcccgctttgtgtccaagaaaggcaactgcaacgtggcccacaagaacatccgggagcagggccgcttcctgcaggacgtgttcaccacgctggtggacctcaagtggccacacacattgctcatcttcaccatgtccttcctgtgcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgagcctcatcgtgcagaacatcgtggggctcatgatcaacgccatcatgcttggctgcatcttcatgaagactgcccaagcccaccgcagggctgagaccctcatcttcagcaagcatgcggtgatcgctctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactctacgacctggcacccagcgacctgcaccaccaccaggacctcgagatcatcgtcatcctggaaggcgtggtggaaaccacgggcatcaccacccaggcccgcacctcctacctggccgatgagatcctgtggggccagcgctttgtgcccattgtagctgaggaggacggacgttactctgtggactactccaagtttggcaacaccatcaaagtgcccacaccactctgcacggcccgccagcttgatgaggaccacagcctactggaagctctgaccctcgcctcagcccgcgggcccctgcgcaagcgcagcgtgcccatggccaaggccaagcccaagttcagcatctctccagattccctgtcctgagccatggtctctcgggccccccacacgcgtgtgtacacacggaccatgtggtatgtagcccagccagggcctggtgtgaggctgggccagcctcagctcagcctccccctgctgctcatccagggtgttacaaggcacttgtcactatgctatttctggcctcagcaggaacctgtactgggttatttttgtccctgctcctcccaacccaatttaggactggctcacccctctcccccgcccaaggctgcag

SEQ ID NO: 1671 - DNA, 704 bp, Homo sapiens
  Genbank Accession No. D50663
gccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatct

SEQ ID NO: 1672 - DNA, 2083 bp, Homo sapiens
  Genbank Accession No. D50913
agacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgaggacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctt

SEQ ID NO: 1673 - DNA, 2108 bp, Homo sapiens
  Genbank Accession No. D50914
gattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccacagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctg

SEQ ID NO: 1674 - DNA, 401 bp, Homo sapiens
  Genbank Accession No. D51072
  unsure (1)..(401): n = a or c or g or t
aacatgtttaattttaagaatagagataatggtcaactcttgagaagaaccaaatgctggtgccatcttggaagtgctacatcacctcctcctcttacnnnnnnaacagcaatatttctggatttcttctgcaagccccaggcagtccaggatgcgtttcttttcagcagccagttccttctcagagaactggcccaagagtttctggacaaatatattttgatctttcagaaatatgttcttattcactcnnacatttggcacattctccaaggacccagacttgaaatggaannnaaatatctgtttcgttttagaccaggcctttttcttcaatccatgacagtggacttttcttctctgtctccagacacacttcattttmawatactgacctcctt

SEQ ID NO: 1675 - DNA, 509 bp, Homo sapiens
  Genbank Accession No. D51112
csgcagttcattttctttattttttcacamgcttygaattcmgaaataagagccacaacacgtysgttgttaagtaaaaacbggrgtgattacaamggaaaactttgtacaaaactttaaaaatctgactgccccgtcaactgcctcagcgggaccargrctcagggcacgsaggggcagccatcagccccccatcgtcagccccgaaybgggatggggagacctctttytgagtgtgaaccyggstcggsctgaagcctagagctggcttgaagaacacacacagaccagaagacagcacggtgagttacaagtgccacggagaccagggtttctgacacaggatgtggaggatgcttctctgcaacctagtgcaaggcttcccctgccattccgagaattcacggatctcacaggbggaggtggggcgagcttctttctagtgtggaccagaggyggggggcaatgagtaaacatcttcactgtagggtttygggctgccctcaggg

SEQ ID NO: 1676 - DNA, 336 bp, Homo sapiens
  Genbank Accession No. D51133
  unsure (1)..(336): n = a or c or g or t
ctgacagcaatagattnntaagtatccccgaaaatataaacacaaaccagtaaaaaacaaaaccgtaaaacgtcaggcctggagctgcaataagacagagacaggagcagctcacacgbggcctaggtggggaggacgaggccataaatactgcaggagggcggcaagggagcccyagggcgaggggaaagcagggtgtcggcagcaagatggctccgggggtttagacactgctggcttcggcccggcgccacctgcctctcactccagctgcgagcagcttcactyggggcctgggctccgactcctcctcgtcgtcttcgtacatctcgccct

SEQ ID NO: 1677 - DNA, 496 bp, Homo sapiens
  Genbank Accession No. D51199
  unsure (1)..(496): n = a or c or g or t
cccycccttaaaggmctttatttctctatttttatatgghtcatttattawwttagaagactaaaaagtaaaawtatattnnvcaatcaaagaaaaatctggacaatggaccccagtaaaataatcagaagcgcacgttctgagaccactcctgcctggcaccctgcagggtagcgcccagggrgcatctkttkdkkggagabgdgaggagggggagcctccggcgacctgtcttctatctccggagccccgcctgaggctccaagatggmacagtcaggctgtccttagtgaccgctgccacggagctggcgatcggcctgcatcttcaaacccaggagcaggagcagcagaggctggcaaggcctgggccctcagacaccaggggcctaaacccagctcccaaacccactgcagcctccccttgtgagctggmagacaagcctgccctctgrgtgtgacgccccatccacacctgacamaggggggggsggggg

SEQ ID NO: 1678 - DNA, 313 bp, Homo sapiens
  Genbank Accession No. D51276
aacagcacygtgcagttttattaaccattcacgtccagtagcatccggtaagatygggacagaatygggattgaaaagtgaacagatattcagcatctaacagttcaaamgacgccactacatactcttttcacaaatmcgttttcacagagccaatacagtactmgccattaacccmgtacaccacgygtactgacgtagaaamgatgcaacacgaaaaatagctacattmgaamgaccaacactttmgaaaacgvgtaaaacactttccgtttctcccctttcgcccytaaaacaacatcttacagycygg

SEQ ID NO: 1679 - DNA, 288 bp, Homo sapiens
  Genbank Accession No. D51279
  unsure (1)..(288): n = a or c or g or t
gctttttaaatngctttattagctttaaatttyyccatgcaaatsggtgaactactgctgacagaaacttacactgrgtgcaaaggcaatctytcaaatagaagctggcaacacaagmcccacttgacacatggaaataacatagggttcacagcaaacggatcagtaaaggcatattaggraaatgcaaggaaaaagaaaacagcgggaatcacagtattaatctcatgataaatggcaggggtcaaggcataaggcaaawttcatcatgatggtcatggtgwttag

SEQ ID NO: 1680 - DNA, 355 bp, Homo sapiens
  Genbank Accession No. D51287
raatgkvagccaaagwtttatttcttmatttcttgcatttgaaatactcttcaatgmcatccttggcctgrgmctccttgccatagtccttaactaytacamaactgaaaccaaccactttasggggtttcccctcyctgycaattttacaaaggcctacccattctcctagtttcttgttgtcatcaaccttawttaggttgwtttggtgttcagcamaaagggcctccaccaacttgacatacataggytcatcacagttggatgmaagcacacaaagatgggcttggcgcttcccaaggctttggcagttcgsgaattccacgtgctaggccatcgtggatgagggcascct

SEQ ID NO: 1681 - DNA, 229 bp, Homo sapiens
  Genbank Accession No. D51393
  unsure (1)..(229): n = a or c or g or t
ctcactgcctgtataatcmsgtctttattcaaaagamgctgtccaaaatgatttgacctttaysgaataatcaaatttaagagtttatgcagcasgcttcttctcctctgtagtaggtttcttctctgcmggcttcttttcmggggctggtttcttggtagctgctgcctttwwtcccaccagmvscttcttcygcttcttaacaccaacagcagcctcyntcctktct

SEQ ID NO: 1682 - DNA, 328 bp, Homo sapiens
  Genbank Accession No. D52097
aaaccttccttaaagattctttgatgctttgctctatcactgtagacctggtctttttccccccagttttttcttttttacattctgggttgctattttcagattaataattbgatggmcccatcacagtaccaaaatacccccaaaatgaagttcaaatttgatcacaacataaatcagagtgagtgagtaacattatahvcgsscaggcagcaggaaagtcaccctcaactaccatctgactggtcaggtctcacccatgccaaggggggcaggaagrggrgaaatcctcgtsccgaattcctgcagcccggggggtccactagtt

SEQ ID NO: 1683 - DNA, 410 bp, Homo sapiens
  Genbank Accession No. D52632
cagagtctgatcttatttatttgttactcaaaaaatcttatttctgmctggattcagacttagaagtagaagctcgcagagaggaaagyctgcsyctcttcgcaatttgttcctggsgyttcyccttagcctccttcattctcttggccaaaagtttagcatattctgcagcctcttctttattyyycttggtacgctgcttcttcagagcaatacgccgccgtttktbctgcaggacacgkggrgtaacaagacgctgaatcttgggkgytttggtcctaggtttcttaccttctttatttaagggctttcttacaacatactggsggacatcatcttctttagagagattaaaagtttgcgattcgctagctcttttggggcccaggsggcgrggcactgtagtatca

SEQ ID NO: 1684 - DNA, 317 bp, Homo sapiens
  Genbank Accession No. D53139
acttgaaacacaaagctttatttaaaggrgcatctcagttacgtgtggcggacaaaaaaaaggrgcagactgtgacagaccattcccatcggccaagtggtcgaacccgacatccaagaccvgcgagcagccaagctcagcgsaacctccgggsttctcgstctgactccaaaagggtgaccgtcgccctcggsacggggccttttacattkcggatgayggatcsgctcgtgtcgtbccatgaattccacgcgcacctgcgtgcactgtccctgagaaccggtcctgcccaggaccttggtgacccysgccagctt

SEQ ID NO: 1685 - DNA, 272 bp, Homo sapiens
  Genbank Accession No. D54296
gtaggacaatggtatatttatttacaatccgaccaaaaaaaggcatacaggcatttttttaattaamaataataatgataatghtttammavgtcagaaaaattgatgatctttgaaccctttatgrggkgtccgtttcccattccccctaaaaagagaatctcttagggaaaaaaaaaaatccaagatttgaatgaacaaaagvctccaatatcgctctctactgcttgggttccctttctccaacttgatgcttggkggatgccscttgg

SEQ ID NO: 1686 - DNA, 2427 bp, Homo sapiens
  Genbank Accession No. D55716
gacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcagcaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 1687 - DNA, 308 bp, Homo sapiens
  Genbank Accession No. D56989
ctaaatgctttaatttyytstcacaaatatttctgcatctctcagtcccttcttgttggaaaaaggagggctagtsatacatttstyaatggcacttttaaaatgtrgctttggtatatagaggtaacactgtacttctyaggtatgtyaataatammtymmggttataatggttgccatattagagaaaatgaataagcattagtctcagcaaaaacaaaaattagtttggmagtagataagctagacatatcamamctgcaaaammmtagcttcccagatagcgcttctactatgctgcamwtycc

SEQ ID NO: 1688 - DNA, 330 bp, Homo sapiens
  Genbank Accession No. D57317
aagattgtattacttgattttattttacactaggtggtgggcagacaaagtaatccttaataaagttgacaattagcttcactcaatatttttaataatgcacattaaaaaaaagtattcatcttacaaattcttctgcaatccaaacatacaatagcttggagaacatttagaaaacaaaagccaatgtaaaaagacagattaaaacaactagaacagtacaggttttatttatatggctcgaattttacagttttcttactgcatcatcaatgtcagaaatctgttccttcagctggctccattgttctggattaaagaaataccttt

SEQ ID NO: 1689 - DNA, 245 bp, Homo sapiens
  Genbank Accession No. D57489
gaagtcttacattttatttaaatagcctccagtaagaagagagtgggccaattactaccccttccttgtaaaatgaagtaaccaagccaaggagggtaagtgcacccagcagccagccagccatgtgatgggtggggtgcctctcagtgggggcggccacgaccacggccccggccttctgctgtgggagcatccacagtcgagcggggttttttgatggtttcatttacagacaggtcaggacg

SEQ ID NO: 1690 - DNA, 383 bp, Homo sapiens
  Genbank Accession No. D57823
cttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaacttaagaaaaaattgtttatgtgttatattcaattagcttaaataagttgctttgttatattttatttgaattgaactacggtaggcctaaatgccaataaaatatacttttcactgtt

SEQ ID NO: 1691 - DNA, 405 bp, Homo sapiens
  Genbank Accession No. D57916
aaaaccttatctgctagacaatgtaagattcacacagagttatctggggattctgatttttaaaatagtacatatcattaaaccattttctctaaatgtaagaagagcagaaaaaatcttataagattatcagatttttctaattgacacagaaatgtaagaaaaaaatccctttatattgaaaaaagatgcagtcaaagtcttttcagacatccccaaactttgagaatttcttcaaccatctaatgctataaagatttttgttcttcctgttcacaaccagttgtataacagaaatactagctactgttttccttcctgtgtgtgaaggaatgaatcattgattatgtgacttgttatgtattcaattaaacactaaagaataaaacattcactcctttaatt

SEQ ID NO: 1692 - DNA, 245 bp, Homo sapiens
  Genbank Accession No. D58231
ctttattaaaaccttagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgt

SEQ ID NO: 1693 - DNA, 454 bp, Homo sapiens
  Genbank Accession No. D59294
  unsure (1)..(454): n = a or c or g or t
aagctttcaaagacaggtttatttatatataagtgcatgamattgaatacagaaactttattaaaatactgtatattacaaatttttaatccaataaattctgtgtaatgacatttaagtgctggattcactttttaacagttgtcttgtgtgtatcagtaaagrgttcaccctgtatattacaaagaggagagccacatgtggacctcagaaatggtcctgtgattagacactgaatgatagtaattgtgcatcttttccttaaagcaatgaattggaacctagatcttatctttgtagacctactttctataattaamaataacttgcatatgttattgctgccctttgaagaaaatgagaatggtgaaaaataatttaamataaagntcaacatctctaggctaaactgatgcttactgcattaaaattacttaaaatcactgcaaatttg

SEQ ID NO: 1694 - DNA, 269 bp, Homo sapiens
  Genbank Accession No. D59322
atttcaatmttttaatasytttatwtcgaaagrgaagctaagmcytkddttaaaaacatttccagagagaacactttataccataaaataaacbtgtatactttgggaggacaaatcatctcaamtsymtcbkbdtgavttatgtgccacbkttataattagtacaaaavtgacagctcgaactcybtttaaaavtgtaaaaaccagtccaggsaacataactataccmtcttgctgtaaagtacttatatcgvttccgcacaaactct

SEQ ID NO: 1695 - DNA, 302 bp, Homo sapiens
  Genbank Accession No. D59344
  unsure (1)..(302): n = a or c or g or t
caattttattytttaaaaatggaatattcaaagtacttttctttcaaatatcaacacataatgtttamctttaaatatttacagcatgttgttgtgatgctcttgtagaaaaatgcatgcttctggcctgrdagccagagcaaaatgcaaaagaccatttaactgcagccagagaacatgaacctgtacagtatccagtcacttttsagcacaggagavcaggvntacaaaattggracctattgtttcctagcaacatggctcagaccattataacacamyyttcaatatgawyacdmccc

SEQ ID NO: 1696 - DNA, 356 bp, Homo sapiens
  Genbank Accession No. D59355
  unsure (1)..(356): n = a or c or g or t
gtttctagtgaatttaatgcatgagtctcaaaaatcaatggcaaaggaaaaaatgaataaaattaaaatsgggtcaggagaaaagggccatgggcacacacaggaggggcagtcagtgcgctgagctaggcagtctgaagcagggggaattcctytagcgtgctcatactctcgtccaacccgmtagatcctccgtscgngnnagctccccccaccgykcacgactgtktnncttgcacaaagcgcgcccatacttncgccgtggmcattcgaagtagcgctttcccattcacactgccatcatttttccccagtgcgctcatcatagcggacaccaatccagtagccaggcttga

SEQ ID NO: 1697 - DNA, 255 bp, Homo sapiens
  Genbank Accession No. D59553
tttgcacagtatcaatacctttaatactataattttcaagatgcgcaaaataaaattttaaggcaaaaacagcactttgcaacaatttaatatttatcacattacagtagcatcacaccagcagtcaataatgccactttaggcaaaagtctttcagtatttctgtacacattctgttaacaagaacccatacattggtaaahttcattctaaggaaacttggcaaacaaagctttggactggaattggcatttc

SEQ ID NO: 1698 - DNA, 269 bp, Homo sapiens
  Genbank Accession No. D59554
  unsure (1)..(269): n = a or c or g or t
gcggacagtaaaccgtttattactgtgtggacacagacaccgtggtgcatgacagacagtttcaacaccatgagcgctggggnnnnngctgtgcctggvcagctctgcggtgtgtggtggvgccacgttgggccggttgtcaccgccagttgaggggttaacagcgtcacctgggggaaamcctggaaaccgtctaatgaagcaggtghcttaggggcgtctctagaaacctstgtgccgatttctctgcgagcccgggggtctcctct

SEQ ID NO: 1699 - DNA, 337 bp, Homo sapiens
  Genbank Accession No. D59570
aattggcattaaaagtttttatttagtatttgabccamaatttatamaagttatttamaaggsatgaaaatggaaaacagcacaaaatacaattgrggtataagctcagrgcacagtatgycatgtttcaataaatataattcaaaatttgtaaactaggkgmccagatacatgrgycttatttttagtaaaaccatwtaaaatwtttwtttcacgtgaggtagrggmcagttttctgtgtcatgtaatgcaaccaaccacagcaactttamccataaaactgtacatcattggvaaawttttaactttaattatggtcaatgtagccaattttttt

SEQ ID NO: 1700 - DNA, 352 bp, Homo sapiens
  Genbank Accession No. D59714
  unsure (1)..(352): n = a or c or g or t
attaaataaaagttttgcttttatttaaaataaaatkcatttatacagtccttbgaacccattggattatttgaacmacatactggtaatccaccctctcccctcgcacccctttytgggtctatgtgakctaggamatttctctgatctagnancawatatmagattgtacacagcgcaacagmtctagaacatggccagtccaggcattagagttaaggacattgtggcaaatcatgatcataatgaagtcattcttaatttagtagatattaamctgacgttaattatatctcttaaaggcatttaattaacggagagatttctacawttavgccatctbctagttgtg

SEQ ID NO: 1701 - DNA, 301 bp, Homo sapiens
  Genbank Accession No. D59847
gcttcagatcatgtttattgkggggccagggggtagggatcctcgggtgagagggctggctggccggggtaagttgctctggacgtgctggcggggagcagtcctggtggcgggatggcgggggcacttctgggtcccagggtgcacgggatccgggcagtgctcagggtggcaagaggcggcgtgcaggcacctggggcgccggggtctctaggcgtttcacacgsagcagcgcccccagcacgccctcagggggcagctcagagcccacatcgtggtcggcggcacggcggaggcggcg

SEQ ID NO: 1702 - DNA, 304 bp, Homo sapiens
  Genbank Accession No. D60670
aaatatacaactcacactttattttagttaaattcataatgtaggtaatattaaaaattattataaacatttaataatgctttataattygctattatagtacaccactacagacacataaaamgttgacttatctaattaaaacattttcccttcctatgtttctaattctgaaaactataaaaatattagtcatgttacatatttttcaaaaataaaactgccatatcccattgccaactttacatgaaaaaggtatatgtbytggtatattaggmggttatgatgaaaatataggttcaga

SEQ ID NO: 1703 - DNA, 396 bp, Homo sapiens
  Genbank Accession No. D60769
attgctgaacaccaatatgtcactttattatttggvtttybyttcccatttgtcacatacctgtcaatgttacacaatgrgggaaatcaaccagcattggaagcaactgaccaaatcagttgataattctgtaccctcttaacacacatcaattttcacttggtagggattatcttaatycggtctcacagctattcttaaaattggtgtcaagattgycacatctttaawtacagwtagahttgccagargtacatawttatatatvtctvbsccacatacagaaamtacaagactgtttcccacaatatttaatttatacactactgtaactatatgcmccttttgaagacaggttaagggghacaagtactktttagrgcaagwaagtagttt

SEQ ID NO: 1704 - DNA, 327 bp, Homo sapiens
  Genbank Accession No. D60811
gaagtaaatcatcttttattttcatcttacatttggttatcatgagacatgcaaactcctccaattttaatgrgaacagtgtttttstgtctttttatcacatatccsyttaatattaggtgtaatattsctaagycggattcgmatatgrggkgcagcatcaagtctttycctatattybgtttttgttgcagcgtaatatgaaaaccccgtttcacacaggkgcattgtagcaaaaggaagaagtacacgcactgcacgccttgcaatgcttgggwattcctgaattaggctactccaaaamtcatttagtgaaagtccactaaa

SEQ ID NO: 1705 - DNA, 253 bp, Homo sapiens
  Genbank Accession No. D60856
  unsure (1)..(244): n = a or c or g or t
gttgatggagaatgttttatttatgtaattyycatctgtagagnngcttctstccnnatctttatatttgtctccctcttctcattgaactgcaaaattcctgaagggatgggacctgggatgtttaatgcaaaccgtacattctcagcagagcacaagtatcaargggacattggatatattbyaataatgvyctaacacaagcaaaaataaccactgaaaatataaaactcaacaagagacataagraaaa

SEQ ID NO: 1706 - DNA, 320 bp, Homo sapiens
  Genbank Accession No. D61991
tgtttatattactggtattagtcttagcctaatgaacctaattatttttcttttgtattctttgcttcctcaaatagcatctgcagcaattggaatgagaaatccagatatgtgtttcaagtagtacattgctgaatcacaaatcacttgatcacagtattgtatataatccctgatccyatttgtytcattttattgtaaattcccatttgcatcaaaacctaatgatagtgattggtaagtaaaacaaatggtgtattgttttcatacagtgttttcacaaaagccatttgcctaggcagcaaaaaatattatttgtt

SEQ ID NO: 1707 - DNA, 327 bp, Homo sapiens
  Genbank Accession No. D62103
tsttaaatgtgattatacttctctttgactygtcagcttagctttagctgatacactctggtgcccaactattattgtatcagtgaacttccactttcttttccttttctctcaatttttgttgtatcattcctaccttgtgaggacatataatatttacattctgttgtcatcctcacatttcttagttccacagtttaaatgtatttgaaactcaaaacattcccattaatctcttggtcagctgaaattaatgatttaatagtttccttaaaaaagactcatggaacaatttccctaaatttttgccatgtcaaatatgtttat

SEQ ID NO: 1708 - DNA, 224 bp, Homo sapiens
  Genbank Accession No. D62518
gactattactagtaagacatttattaatgatattattacaattgtttctaaaatccattattatttcagcagcgaagagataaataccagagtaacctcagtcagatggtaacagttaggtctaaagaaaattatatgaaatactgactgtaatactgctatagagtatacagtatgttaaaacatgatggagaggctgcacacattggtaacgttttatgtca

SEQ ID NO: 1709 - DNA, 364 bp, Homo sapiens
  Genbank Accession No. D63160
cctgcacaggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggtttgggagcttggccctacggtttgtaaaagaaacacatgtcgtgattcta

SEQ ID NO: 1710 - DNA, 852 bp, Homo sapiens
  Genbank Accession No. D63391
ggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 1711 - DNA, 3411 bp, Homo sapiens
  Genbank Accession No. D63478
cccgactaagtgacttaaactcccacctactcctggaataaggagtcaaagcccggataggcgcagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttctttagctaac

SEQ ID NO: 1712 - DNA, 6322 bp, Homo sapiens
  Genbank Accession No. D63486
ctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcaggttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccttccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggtaggaaaagagcaggatggatctcttgggacaggttcccccaggagtataaacacaaggagccaggattgtcctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgac

SEQ ID NO: 1713 - DNA, 3394 bp, Homo sapiens
  Genbank Accession No. D63487
gtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagccccagccccaggcgccccttgccgaaggatcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctctt

SEQ ID NO: 1714 - DNA, 1194 bp, Homo sapiens
  Genbank Accession No. D63874
ttaattcggcggccgcggatccgagccggacgggcactgggcgactctgtgcttcgctgaggaaaaataactaaacatgggcaaaggagatcctaagaagccgagacggaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgaaaagctgaaggaaaaatacgaaaaggatattgctgcatatcgagctaaaggaaagcctgatgcagcaaaaaagggagttgtcaaggctgaaaaaagcaagaaaaagaaggaagaggaggaaggtgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtatcttcaatagccactaaccctgcctggtacagtatgggggttgtaaattggcatggaaatttaaagcaggttcttgtttgggcacagcacaaattagttatatatggggatggtagttttttcatcttcagttgtctctgatgcagctatacgaaataattgttgttctgttaactgaataccactctgtaattgcaaaaaaaaaaaaaaagttgcagctgttttgttgacattctgaatgcttctaagtaaatacaattttttttattaaaaaaaaaa

SEQ ID NO: 1715 - DNA, 5547 bp, Homo sapiens
  Genbank Accession No. D63880
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatattaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatcctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatccctaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttt

SEQ ID NO: 1716 - DNA, 3138 bp, Homo sapiens
  Genbank Accession No. D76435
cgggtgccatgcagctttctctaatttgctctcagttcctggctatgaattgctaaactatcagtctcgcgctcaccgcccggctgaggaggtgaaagtttctccccaggaagataaaccgcaaaagacatatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggaggaaggaaggaggggcggctgcgcgaggcggagagagggcgaagcagtcgcggcactggcgctcacattcctctatgctacaaatccaggaggaagtttttttttagggggctgagatgctccatgcctttaaaagggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgccgcgcggcgcgcgcgcgccattgcctgcaggctaggacttcgcgaggtgggtcgactcaccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacagccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttccgtgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagacttgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctcaaa

SEQ ID NO: 1717 - DNA, 2123 bp, Homo sapiens
  Genbank Accession No. D78011
gcagcctgaggcagagctcgggggctgtcggtggggaccttgcaggagggcaccccaagcccgcccggcccgcccaacccagcccctgcgcgcagcccgggccgagtaggaccccgcgcgcccctcgctatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttatacctt

SEQ ID NO: 1718 - DNA, 1063 bp, Homo sapiens
  Genbank Accession No. D78361
cgaagcggagtgagaaggacggtcccgttcgtcacgaacgtccgtccctcgtccgtcgcggctcggacccggtccgggagagcagtggcggtggtgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacaattttattccgg

SEQ ID NO: 1719 - DNA, 338 bp, Homo sapiens
  Genbank Accession No. D78676
  unsure (1)..(338): n = a or c or g or t
gtttaatggaaacctgctgggctggagggagttaggctgaatttcccgacttcctctgccagttattgacacagctctctttgtaagagaggaaagaaactaaacccacccaagggatgatttcnnggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggggagggagaacccctggccccatgggaaag

SEQ ID NO: 1720 - DNA, 416 bp, Homo sapiens
  Genbank Accession No. D78725
caatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaattgtgtttttttaaaaatacatgtctagtctgtccttaatagctctcttaaataagctatgatattaatcag

SEQ ID NO: 1721 - DNA, 371 bp, Homo sapiens
  Genbank Accession No. D79205
cagccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 1722 - DNA, 381 bp, Homo sapiens
  Genbank Accession No. D79276
gtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggraccttatttgaatgtgttttttttttccatgatgtccaattttgttgtgggaaaggatttggataaaatttttgtttaaattttggagrttttatctatacaattyaaataa

SEQ ID NO: 1723 - DNA, 460 bp, Homo sapiens
  Genbank Accession No. D79687
gcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtggtacagttttcaaatgttgttaccagtgaacacccttgtggtttaacttkg

SEQ ID NO: 1724 - DNA, 6940 bp, Homo sapiens
  Genbank Accession No. D79992
cttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatgcatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctgcagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagcctcccacctccacagaccgacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1725 - DNA, 2470 bp, Homo sapiens
  Genbank Accession No. D79997
ttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 1726 - DNA, 377 bp, Homo sapiens
  Genbank Accession No. D80050
  unsure (1)..(377): n = a or c or g or t
agtaaaagctaatctttattgagcacttactatgtgccaracccgttaaaaaattaccttaaatatatgcactcattttatccccatgatagccctattaagtagattcnnacaacagaaaaaaaagctgagacacagaaaagtaactbgccacatttacacaactattaagcaacaaaactgatagcaacctagtcagtctggtgccaggstaagtaaattaaaaaattcagatactggtaagtattgagtggaaaataagacaaacaagtaatgtgatagtgaagaggaggcatttgaactgagatctaaatgacaagaagaagccartctgcaaaaatctggggaagagcattccmggctgagaaaatagaaag

SEQ ID NO: 1727 - DNA, 237 bp, Homo sapiens
  Genbank Accession No. D80217
ggtagatagtaggatttattttaattttycaatctgaaaaaaaaaaaacccaaaacaaaaaaaaacaaactatcctcatatatatatatmcmgtgtcaacattttcagrgcacttacattaggaaacattktttctcttcaactgtatgacaatactgtatatgccacaataaaattyacaaaaacaatcgcatcagcagtcataacaaacatcatgatttymcatttcactvcaca

SEQ ID NO: 1728 - DNA, 245 bp, Homo sapiens
  Genbank Accession No. D80218
  unsure (1)..(245): n = a or c or g or t
ctttttaattgtttaactttattactgttgcaccatttatacaattacatataattbcaatgcatccattgtacatttbbbbgtttttbtyttgtttttyttttccattttccaatgagtggtgtgttggkgtctgtsacacagaatggaagagaaactggaactgcaatgaacgsagactttytyycyyttttttttcatttccactgaccaataaacagaactacaggtgcacccahccangg

SEQ ID NO: 1729 - DNA, 377 bp, Homo sapiens
  Genbank Accession No. D80237
ccycatgcagccccaaagggvaaaaagrgactttaattaggggagggaggatccaccagaatcagaaaagggacagytagcgtgggagcagaggrgccagaacaggcaggrggrgggcccggccaggaagytytggrggactcacctcgccacctytggcacaggcactggcactgacggacaaggsgaaacagcggcccctctcaactgggrgggcaccaatggcccctgtagccagaggttgcccggcttttgggccccaggtcctaggcatgactggtggtcaccaatttggcccttktccccaaccagtgctggggggccatctttaggcagaactcaggaagcctcgtsccgaattcctgcagcccggggga

SEQ ID NO: 1730 - DNA, 224 bp, Homo sapiens
  Genbank Accession No. D80312
gaggggagatgacgccyttttattaaggttaacaccaaggaaagcattgagaaggaatacacaaaggmgggggmgggcacacaaagtcaccacttgaggmggtggaagggcggcacatcagtaaaagaacctcaggacagccacatgctccatgccctggttgggggaagagggagagaaagcgccattgatagyttggagctcgwagaagctcgkgccgaatt

SEQ ID NO: 1731 - DNA, 398 bp, Homo sapiens
  Genbank Accession No. D80408
acatacagcatgatttatttycctattcacctagtactagccaaatgtgtatgtatattgctattataaacaaccctgtgattaacatctttctatcaagatctgcctctactttgaacagtttccttattgccaatagttattttaavatavatagttatttbamvgggaaattgacacatacatataacacactcacgcaaaactggcaagtagcagataagtgctcttctaattccagtytcctagctttcatgtagaatgaacawttatagtaatamasgctgamggaaaacamagatattattgagatacaacagggacagtctaaaacagcatcagavagcaagttcatgctgttcaacattagcaggcaagggaawtagggaagavwtacg

SEQ ID NO: 1732 - DNA, 313 bp, Homo sapiens
  Genbank Accession No. D80420
agcaaaaatgtttaatctctccttaatgtgtgtstttatymcaagtactaaatctgaagaacagtaaaataggaaatagccgtatatgtacacatctbmsggccgggcccacagtcagcggtgctgcttctgcaaagagcccsgctgagggtgbccbbccggaccgtccgagggatcgctcttcttctgggagggggttctgcggtgttaaaggacagctaattgtgggstttgtcttaaaaawatctctctctctaaatatatctatyctagctktgtagcaccaacgtgagcmtctaattctmtgacaggg

SEQ ID NO: 1733 - DNA, 288 bp, Homo sapiens
  Genbank Accession No. D80662
ggctttcctcacttctcaggctttattgggctttatttgygggagaagggggctggtccccagtttttgcagtgcaaagccagagcgcsacctgctggtagccctcaggtgtaggttcgaagctgctggggccccctggggtttgggacacaggagaatttcaggctktgagtggagacagttactgccacgattccacaggcaagttgttcacctcaaagatctgctgcaccgactggtgaaagtsgtcgtaggtgaggcgcasttttagccgmaggggggccttkt

SEQ ID NO: 1734 - DNA, 281 bp, Homo sapiens
  Genbank Accession No. D80710
  unsure (1)..(281): n = a or c or g or t
gacgytcacacttagtttttattagccacagtttcccacagttttctaccycctaggaaatacacagctcaccaagggcacccagtcaccattctgtcctgcttgcatggctgacactgtngctcaccggggggtgagcagatctgcaaagtcacccagggcctggtttcctcaggtacagagaaccccaaagraaggagggccagaacttagrgcccctttcttctccatatgggataggacacccagacaatgcccatgcatcatgaaacaggggcagg

SEQ ID NO: 1735 - DNA, 372 bp, Homo sapiens
  Genbank Accession No. D80905
caaagatgtctcagtttattagttttctgtcaatcattaaaacaagaaagatgaaacatgcaattagatacaaggagacagaactcctaattctttcgtcctagctgaagcagaagagttttaattgcttggaaaaataagattttcgttttctctcaagagggaagaggaagcaaatataaatcgccttagagtctatggctggaggtacaatgctccaaaccatgcaaatgagaggtggaaagacaagtccatcatctgtatgttttgtctttacaatggccaatatccagatattcagaaatgtgagataatcggcagaatatgctttbytcattagaatgtttagagtcacatagatttactgattct

SEQ ID NO: 1736 - DNA, 274 bp, Homo sapiens
  Genbank Accession No. D80917
  unsure (1)..(274): n = a or c or g or t
aaaactaagtcagatttttatttttttttccatagaccacatcatttaataataaaaaaaataaaaataaaahttgaacaaaaggaaaaggtggatataaagtggaacctgtgggaaagaggcaagggnhgcaggacagaagagacnsgggaactygcaggggccctgggactcaggrggagatgctgattmcabctvcataggtgacccagtcctggccccggytgttcccaagagaaggytdtaagtacccaggggggtggwaagcagatgg

SEQ ID NO: 1737 - DNA, 336 bp, Homo sapiens
  Genbank Accession No. D80946
aggttattaaataattygtttattgtacggcatttacaaagaaaacgacaatgcctcagtagaagaataaaaatgtatttagggctttatttttaactgacagcaaatagaaatsctttagtgagatcgtggcaatttgacagtattataattavgstcaataaaggtacatggggtacctggaagrtcaagatctacagctgcctatttccacatctttcaatccatctggstccttaaataggggaaaaagcccttattggkggrggaaggatttccaaatgagttamaggttctattaaaactactgtccatcaactbttwaaatagggcctt

SEQ ID NO: 1738 - DNA, 308 bp, Homo sapiens
  Genbank Accession No. D80948
atttttctgctgtttaattgatcctcaaggaaggagaaattcaagtccacaaaaacttacatcaattctgtttatcacatacaaaactaaacatacaatataacagcaaataacaaacatgctgaatatttycaagccattttgaatggggtccygwacawgtacataaataatacatactgctttctgaattaccttaaaatacagtaccaccargggttatatttctwtgdaactactccataagkgggcataaaggdttggggrrgdagvcgttatccatwtcagataaaggagaaagtyttwtt

SEQ ID NO: 1739 - DNA, 381 bp, Homo sapiens
  Genbank Accession No. D81048
  unsure (1)..(381): n = a or c or g or t
gnagaaaaaggctgacttttattttcctgcagagcatcttcctcgggagagcagggagccccaabtcatcbbngttaagagcaggngamtccccttgactaggttggggtctgagcccagaggcagggcctaaggaggtgcagagactagggccgggagtggtgaggcaaggttggggcctggagggacagctatgaccgttgaacttgcagaccctggtccaccttcttggagtggaagccagcsgtgcagaaggggacccmtgaggcgcagaggcaagtaacagtgccaggggagtggtcagggcagatcctttccttctcaggaggctgttgagggggagavtctcatvctctaaacagtgaagggacagatgacttc

SEQ ID NO: 1740 - DNA, 313 bp, Homo sapiens
  Genbank Accession No. D81608
ccaaaaccacagaaagggaaactttggatsabgggggcactactgtacttaggaatacaactatatacatatgattttatttttaagaccatattatatttsggtatctactaatattttgtataaagcaattttttgttccattacgtgactttttgttttattgtatatgtaatttaacacacaataaagggtaaagttgcttccccaaaccacacttttaatcaaaaccyagaatcatctgcagtccttgttaaaaatgcaggtttctagaaccctctgaagttctgattaaataaatttattgcaaacc

SEQ ID NO: 1741 - DNA, 958 bp, Homo sapiens
  Genbank Accession No. D82061
cgtctcagctccagaaccgactccgctccgcactggccttggtcacaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctagggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatcccctgtaactctgtcctcccagggttcattgcaacacccatgaccaagaaagtgccaaagaaagtggtggacaagattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccatatcctcttccctgcc

SEQ ID NO: 1742 - DNA, 317 bp, Homo sapiens
  Genbank Accession No. D82226
  unsure (1)..(308): n = a or c or g or t
aagatatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcagggggtggggnttctctcgcacccccagcacctctgtcccaaaacctcattcccttttttctttacccaggattggtttcttcaataaatagataagatcgactccaaaaaaa

SEQ ID NO: 1743 - DNA, 371 bp, Homo sapiens
  Genbank Accession No. D82277
  unsure (1)..(371): n = a or c or g or t
gcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctngttcatttctgtatctaccccccttccgnccacgcccccgacctttggtcaataaacatccg

SEQ ID NO: 1744 - DNA, 2068 bp, Homo sapiens
  Genbank Accession No. D82348
cggcagccctcctacctgcgcacgtggtgccgctgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaaaacaatgttttgatctacataaacattgtaaaaattttcaatcacgctttttaactttcttaccacaaaaaaatgataagtgggtgaagtgatggttatgttaattagcgtgc

SEQ ID NO: 1745 - DNA, 434 bp, Homo sapiens
  Genbank Accession No. D82422
  unsure (1)..(434): n = a or c or g or t
ctgaatctgtgcccataatctctgtcagtctgctgnttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggncatcctggctccaaatcctgaagcttgtggcttgctcgtattgatttcagtctcctntgtggcaatggnccacattatgtatttccgatntgcccaaaatactctgggaaacaagctctttgcttgcggtcctgatgcaaaagaagttaggaaggaaaatcaagcaaatacatctgttgtgtgagacagnttaactgttgctatcccgttactagattatatagagcacatgtgcttattg

SEQ ID NO: 1746 - DNA, 259 bp, Homo sapiens
  Genbank Accession No. D82558
ttgggagaagttaaccacagcttcacagactaacatcaagaaatcgccagaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaaca

SEQ ID NO: 1747 - DNA, 2122 bp, Homo sapiens
  Genbank Accession No. D83735
gcccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtcttcccatctgggtttttgggtttttctgtgttttcatctttttttttttttttcttgacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctttgtttgtaggaag

SEQ ID NO: 1748 - DNA, 6604 bp, Homo sapiens
  Genbank Accession No. D83783
gatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacggtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgc

SEQ ID NO: 1749 - DNA, 2917 bp, Homo sapiens
  Genbank Accession No. D84557
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctg

SEQ ID NO: 1750 - DNA, 2067 bp, Homo sapiens
  Genbank Accession No. D85181
cgcaaagttaaacagctaaaagaagtaaaataagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcgacttatcgaatttctcgatctcagccatatcgagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataatt

SEQ ID NO: 1751 - DNA, 463 bp, Homo sapiens
  Genbank Accession No. D85433
gacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgt

SEQ ID NO: 1752 - DNA, 898 bp, Homo sapiens
  Genbank Accession No. D86062
cccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcat

SEQ ID NO: 1753 - DNA, 3614 bp, Homo sapiens
  Genbank Accession No. D86956
ctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttct

SEQ ID NO: 1754 - DNA, 4344 bp, Homo sapiens
  Genbank Accession No. D86957
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctacgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttgacaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctatgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttg

SEQ ID NO: 1755 - DNA, 4689 bp, Homo sapiens
  Genbank Accession No. D86972
ggcggaggccgggccaggcggggctgtagggctggggcaggcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaacctacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttctggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgttttacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagcc

SEQ ID NO: 1756 - DNA, 5471 bp, Homo sapiens
  Genbank Accession No. D86974
caggacacgaggaaactgttaatgacttgggctttggaagtagctgttgtaatgaagaagtccgaaacatatgcacctttattctgtcttccgtctttccataaattttgcaaaggccttttagccgacactctcgttgaagatgtgaatatctgtctgcaggcatgcagcagtctacatgctctatcctcttccttgccagatgatcttttacagagatgtgttgatgtttgccgtgtccaactagtgcaccgtggaacttgtattcgacaagcatttggaaaactgttgaaatcaattcctttaggtgttttcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaaggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatcccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataatctcaagacacctcccgagtgtctgctcactccccttccaccctcagctctaccctcagctccaccctcagcagatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcatcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaat

SEQ ID NO: 1757 - DNA, 4226 bp, Homo sapiens
  Genbank Accession No. D86977
ataatggccgctttcaaggtgtggattttggctccttgagcctgtttgagcgaggggtgggagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactgggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggagggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccagtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatggcccctcgccgcacgccagcccgctttggtctgtgagctgaggctgtccccagagaggatggcagcaggtattgggtcctcagccttctggcgggagccctgaggctgcggacaaagccttttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgt

SEQ ID NO: 1758 - DNA, 5510 bp, Homo sapiens
  Genbank Accession No. D86983
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattggttttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgtt

SEQ ID NO: 1759 - DNA, 5878 bp, Homo sapiens
  Genbank Accession No. D87073
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacaacgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccgtccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgc

SEQ ID NO: 1760 - DNA, 5608 bp, Homo sapiens
  Genbank Accession No. D87075
ctggtatcctggctgctctgcttcatcttcacggtgacagacgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatttccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggaatgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacag

SEQ ID NO: 1761 - DNA, 6219 bp, Homo sapiens
  Genbank Accession No. D87436
gagaagaagtggcaggtgatgctgaagcgggggagaagcggcagagccggccacacagtgcaggggatggagacaggtgctgggctggtcctcctgcagcatcctcagttgttggagggcagtcatcctcaggccgtacccagccagagaagaaaaagaacagtgtgaagccacgtgtgatagccgtccaacatcggctcttccctccaattacattgtagttgattgtgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggtggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgccaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggcagctggtccctctgtccctgtgtctgctagcactagactttgttgctgcagattgatccagtgggtacataggctaattaatgtgagtctttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctgtttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacat

SEQ ID NO: 1762 - DNA, 5918 bp, Homo sapiens
  Genbank Accession No. D87449
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaacccatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctg

SEQ ID NO: 1763 - DNA, 4185 bp, Homo sapiens
  Genbank Accession No. D87466
cgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcag

SEQ ID NO: 1764 - DNA, 722 bp, Homo sapiens
  Genbank Accession No. D87735
cgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttctgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgtt

SEQ ID NO: 1765 - DNA, 3056 bp, Homo sapiens
  Genbank Accession No. D87953
cccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcaacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 1766 - DNA, 2193 bp, Homo sapiens
  Genbank Accession No. D88154
cgatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggctgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgttcagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccata

SEQ ID NO: 1767 - DNA, 1276 bp, Homo sapiens
  Genbank Accession No. D90042
tgagatcacttcccttgcacagtttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattc

SEQ ID NO: 1768 - DNA, 250 bp, Homo sapiens
  Genbank Accession No. D90097
tattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttctt

SEQ ID NO: 1769 - DNA, 5215 bp, Homo sapiens
  Genbank Accession No. D90282
aagcaaccttaaaatgactgcaccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactacttctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgttcagaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcattgctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtagaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccaagatgtccccgaactctgctctggcctccaaaacgactggctacccattggcattcattgctgcaaagattgccctaggaatcccacttccaggaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagagggtttcactccccgtctcccaatgaacaaagaatggccatcgaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggccacgccagtggtgctgacaaaatttgttgaaggggcccgagaagtagaaatggacgctgttggcaaagatggaagggttatctctcatgccatctctgaacatgttgaagatgcaggtgtccactcggagaatgccactctgatgctgcccacacaaaccatcagccaaggggccattgaaaaggtgaaggatgctacccggaagattgcaaaggcttttgccatctctggtccattcaacgtccaatttcttgtcaaaggaaatgatgtcttggtgaatgagtgtaacttgagagcttctcgatccttcccctctgtttccaagactcttggggttgacttcattgatgtggccaccaaggtgttgattggagagaatgttgatgagaaacatcttccaacattggaccatcccataattcctgttgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaacccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatataaaggaactgattcacaactttctcagagatgaatattgataactaaacttcatttcagtttactttgttatgccttaatattctgtgtcttttgcaattaaattgtcagtcacttcttcaaaaccttacagtccttcctaaggttactcttcatgagattcatccatttactaatactgtatttttggtggactaggcttgcctatgtgcttatgtgtagctttttactttttatggtgtgattaatggtgatcaaggtaggaaaagttgtgttctattttcttgaactccttctatactttaagatactctatttttaaaacactatctgcaaactcaggacactttaacagggcagaatactctaaaaacttgataaaattaaatatagatttaatttatgaaccttccatcatgtgtttgtgtattgcttctttttggatcctcattctcacccatttggctaatccaggaatattgttatcccttcccattatattgaagttgagaaatgtgacagagcatttagagtatgaattc

SEQ ID NO: 1770 - DNA, 225 bp, Homo sapiens
  Genbank Accession No. F01444
cacattttagcagttaaacttttattttactgtttaaaatttttatttactttttttgtttttcttttctacaaaaggcaggtgatgattgttgatctgcaactattgtgttgtgcactccccgaaaggggcagagtaggaagccagggaaggtgctctgaggatgctttctaagggctgcaggacactcactggagggagtgtctgggcccttctcctgtcctc

SEQ ID NO: 1771 - DNA, 281 bp, Homo sapiens
  Genbank Accession No. F01538
  unsure (1)..(281): n = a or c or g or t
acaatagcgataaatagaatttattttatacaactnttaccgacatccacacggccacaggggcttccaaaatgggtattggggccaggaggctggcctttggcgtgacgcctaaaaagtgtgaccagacacacaagggctcccagcagctgtgccgggctgccccctccatggcggtcgggggaggcaaggcctggactctcggccagctgagactcttggcctggagggccagcatgggatggcaggggttaagctgggtgctggctgaggagccaggt

SEQ ID NO: 1772 - DNA, 200 bp, Homo sapiens
  Genbank Accession No. F01568
gtgtgaacacgataccagcacctccaacaccacatagaagctgaaagaggggttgagcctctcaacccttgtcctgggagcttcaagtatggtgaggcacaacttttattaaaagagtttacaaacagaactattaaacacacacacacatacacacacacatatacacacacaccccaaaaaaagatacactctccacg

SEQ ID NO: 1773 - DNA, 237 bp, Homo sapiens
  Genbank Accession No. F01831
gtcagtttacacatacatcatgttaatattagaccaaggcacaaaacgtttagtgcataaacccagtttcttttaagatttagcattttattttagtctcttatcttagtttggaccacttgtacccagtactctacctactacagactatttaacttacccaacaaaatcaaaagaggttgctgaccagatttataggggacataactgtttatattatcaaagtgtttgcataac

SEQ ID NO: 1774 - DNA, 237 bp, Homo sapiens
  Genbank Accession No. F02028
aacagtggagtaattttattcacatagggttgcgattaaaaggttaactcattcaaacacatttttgctatgctaacattcctttgcctcttattcttacaaataaacccccatcacagagcagaaatgttagaaattatatcacaaatggagcacaataagtatttttaaaaccttttaaaatatggcttataattttacacagcaagttacctattaatatgttacatattaaca

SEQ ID NO: 1775 - DNA, 309 bp, Homo sapiens
  Genbank Accession No. F02094
aaagagacagggtcttgccatgttgcccaggttggagtgcagtggttattctttcacaggtgtgatcattacacactacagccccaaactcctgtactctagtgatcctcctgccccagcctcttgagtaggtgggactataggagtgtgccaatttctaaaaaggctgttgaagtgttttcttgatctaaaagtgtctgtttcattaactcaatgcaatttccattttattcacatcacttgtatcctctactctcagcttgtcaacccaggatggcaatgacaccaggaaggtaactgtcccaaggg

SEQ ID NO: 1776 - DNA, 298 bp, Homo sapiens
  Genbank Accession No. F02245
gggggtggcagtgcactttattaacaaacaaaacagtaccatacaggcaaaatcttacttcagtggcaaagcacacacataggtatactccaacgtgtagcactggggcaaacttcagacatggaacattaggcaccaagttcacaatcacactaaacatagttcacaatccttcaatccatactcttcagtggaggatgaggccttatttaacagttaactgggacagacagatgaagttttaaaatctaattcttggcctaactgtggagtggggctgactcagccttcagaactg

SEQ ID NO: 1777 - DNA, 236 bp, Homo sapiens
  Genbank Accession No. F02254
aaggaaaggaactttcaatgagaaatcaaaacacagggaaccaaagtgcaaatcatccaccccccatggggggcccatcctgaaccccacatcatcccctcagcccccttcaggcccccagcgcaggcccagggcctggagcttctgcctcaggtagctcttgagctggggcaggcctctctgggactccagttcctcgaagggtagcggcaggagctggtagcccatcaggccta

SEQ ID NO: 1778 - DNA, 166 bp, Homo sapiens
  Genbank Accession No. F02330
  unsure (1)..(166): n = a or c or g or t
aattaaagtaaaagaatttaagtctttatttctaaactgatgcatgaggaccccagtgagcaatattccccaaggcaaatcaaccaaaagcaaaactgttttgaaaaaaaaaaaaaaaaaancccaacatttntgnaattnctgngaaactttatggtntatattt

SEQ ID NO: 1779 - DNA, 298 bp, Homo sapiens
  Genbank Accession No. F02345
  unsure (1)..(298): n = a or c or g or t
acaaaaaatttttggtatttattttcatatgcacttctctataaagagaatatataactttcatatggttattttaaaaagattaaaaactaaaataatattaaaggtttacaggtcatttatatgtgtacccattagcaagtcaccaggcaatcctcagaaatgggggggaagttgagacccccaatggcattgttttttagcatccaaagcacaaagggacttgcaagaatcactgagtgaccagagctctgtagctcacccaacattcctgtgcaagggggtcacaccacgnctg

SEQ ID NO: 1780 - DNA, 321 bp, Homo sapiens
  Genbank Accession No. F02800
cagcatcccaaatttattctccagcagctgtggccgggtgggagaggctaagggaaaaggaggggaggaggagagtcccagagagtggcaggcactggggagagttggggtgggtccgagccagacaggagccatgcacggcaggcgggctgcggggagaagtgatggcttcgggatggggaagtctagaacaaaagctgattgggagcctctggggaaagaatcctccatatatcccagaaatccccagagcacagcagcgggacgtactggaggaggggggcacgcctcccactcatctagaactagagtggaggcggg

SEQ ID NO: 1781 - DNA, 358 bp, Homo sapiens
  Genbank Accession No. F02807
  unsure (1)..(358): n = a or c or g or t
gatacatatatttattatgctgtaaaaagcaacactacctgattgcatttaaaataaatgtttcccaatttcagaatacttacaacttgtagttttaagattagattcactttgggaggttttagaagcaaatacattcatagctgtgtaatccccaggaagaatctaaatctgacatcaggtcattcagtccctgccagacagacaacagcatcaaatggtcaacagctaatccagctctgcagctaaagggcagtgtcgggcagcagtggggtatagcatattaccaaagatgagaccagcaaaaacaacaatgtgtataaagctttaanttaacatgatcatatagagcgctcag

SEQ ID NO: 1782 - DNA, 244 bp, Homo sapiens
  Genbank Accession No. F02863
  unsure (1)..(244): n = a or c or g or t
aggaaaaaaaaagagaaacctttatttacaaccatgggagtcccacaggagtacacaaaacacacaatgtgcacacacacaaaatgaaccttttaagtcaataccatgcgtgctcctggccgcgcgccacccctcagtgccctatccgcaccaccatcacagtgacgttntcggccgagccccgntgcaccgccttnttggccagccttttgcaggctgcttcgtagcgggcgtcggctgcgga

SEQ ID NO: 1783 - DNA, 244 bp, Homo sapiens
  Genbank Accession No. F03200
atgtattttgaaaagtatttacttagtttaaataaattaattgcaaataaaaattaagctacaatatatagcctgaataaaaatgactagaacaaatacaacacaggacttgctttcttgcattagtcacaaagcatgtgacaatctagaaaacttcaaaatcaattacatttctttgaaaaaggggtaacagcagttactgatacatcacaactaataaacttataatacaagtttcctgaca

SEQ ID NO: 1784 - DNA, 244 bp, Homo sapiens
  Genbank Accession No. F03811
  unsure (1)..(244): n = a or c or g or t
cacattttagcagttaaacttttattttactgtttaaaattttnatttactttttttgttttncttttctacaaaaggcaggngatgattgtnganctgcaactattgtgttgtgcactccccgaaaggtncagagtaggangccagggaaggtgctctgaggatgctttctaagggctgcaggacactcactggagggagtgtctgggcccttctcctgtcctcctcagccttccctagctca

SEQ ID NO: 1785 - DNA, 305 bp, Homo sapiens
  Genbank Accession No. F03969
  unsure (1)..(305): n = a or c or g or t
gaactttgggaaaattatttatttctccccacggggttcagacaagtaatttcacatttcattgtaagtcaagggtaagaaaacattttttgtacatccatcactaatagagatcacagtatgtcaatgaaatatttaaatacactgtacagagattgctttttaatggatttctataagtagtattaataggaaaaagcatataatacaatctactctgtatctaagagctttaatttattcaaatattggaagaaattcatctnctgaattttncttatttaaaaagcattatgagaactgat

SEQ ID NO: 1786 - DNA, 349 bp, Homo sapiens
  Genbank Accession No. F04320
ggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcggcaagtttttctgtgataatagacttctgtttatcagataagttattttctacaaccacatcatggagttgattgacgagctgagttgctgcatgaccctcatctattaaatccttgaccacagcttctagtttgtcaaaagagccactctgacaggcagcaaatactccatcaattttctcagctgggt

SEQ ID NO: 1787 - DNA, 287 bp, Homo sapiens
  Genbank Accession No. F04335
ccacttccccaatccctcagctctaaatttatctggaaatattttgagtttttcttacagtggagaactatttgacttagggctacacaacaatgcttgccacctccgtattttgaagatcttcctctgtgaatccttcccacattcaaggaggtacgcaggaaaagcctgtggcaggcagtagcccttgatctaggctgctcagggccacgtagatcatctgaagattgtcacctaaatacagctgttactaaacctttgccaagggaaagcagagaagggacaag

SEQ ID NO: 1788 - DNA, 249 bp, Homo sapiens
  Genbank Accession No. F04444
aggatttctattcatttttattcattcctccaaagagcaccacaggccaaccacacccttgatgtgtccttcatggttccccactgcagtggacacaaatccctccctcattatccaggcatggatggaactctgctgtggtgaggaggttgtctcgcccactcacccaagttttccatgcctgttctgcttttgatggcaatgccaaaattcatcatacatttccttgaattcctgccttcaagggtc

SEQ ID NO: 1789 - DNA, 224 bp, Homo sapiens
  Genbank Accession No. F04479
  unsure (1)..(224): n = a or c or g or t
gaagtggtgcaaagtacatttatttttacaatgaaagctcatctatgaatctnataaaggccttccttcaactggagacaatttgggatgttgcaaaacaaggtttgggaagcccttctatggatcggttttgtgtccaagtctgtccctgccaaaagccatcaaaagtctccatcacccctgggntccagtctgctacccccagacttggcagctgggatctc

SEQ ID NO: 1790 - DNA, 237 bp, Homo sapiens
  Genbank Accession No. F04524
acattgtaaacaccacatttatttgtctgaggcttgcaaacctctggtaagaagcacagaacgcagggctctccttcatgctgccctgggccccagctcgccaggcatgcaggacagagctggcagatgagtcagaaatctttgggagcagcgccagggaagcagcaggccctgctccttcccatgcccaatcccgccagcacgggcctggactgcagccaggaaggtgggccagcc

SEQ ID NO: 1791 - DNA, 222 bp, Homo sapiens
  Genbank Accession No. F04531
gaaattgaaaaattaatttattatatgaagaaacaggacaatatttattagcatcaacgactgcagagaagcagtcaacgaaagctcatatccacaatgcattgactggtaagtactggcacatacactcataaccatagcactaatgttttaaggtggtttccaaagaaatgctgtatttgacaatcaattttaatatatattttcccatttacaaggctg

SEQ ID NO: 1792 - DNA, 274 bp, Homo sapiens
  Genbank Accession No. F04611
acatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagttcctgggaatcattaagcaagcaacataattattttcctgtagtaattcagatcaagtatgtagtacaagttatcattgt

SEQ ID NO: 1793 - DNA, 280 bp, Homo sapiens
  Genbank Accession No. F04674
gtataaaaataattttatttactactgtaaataaagtagtgcaaagagtagtttggacccacaatattgcattactgatttattcactaccttagcagcatgtagtatacagacattctgctcttcctcttcctctctaacacacacacacacacacacacacacacacacacatatccctgtacagactcacgcaggcatgaggggtagggatgaaactataagctagaggcttacttgctgcatattccgttgctgccagtctattctaacgtgtaat

SEQ ID NO: 1794 - DNA, 266 bp, Homo sapiens
  Genbank Accession No. F04677
atggctaatggtgacacactttattaatttaaaaacacgcccttcccacatagtgcgtgaggcatgtgcacattttcctagaaggacatgaatagtgatgtggaggtacggtggaggtcaggcatctacagggtcattcgaggaggaacagattcaagctttcggacgatcagtgttttgtaaatagcagcatcatcagatctaagacaacattggacctggcagggccttttctttgggtggcattaattactccagattcagac

SEQ ID NO: 1795 - DNA, 313 bp, Homo sapiens
  Genbank Accession No. F04944
  unsure (1)..(313): n = a or c or g or t
catttaatctctgaaatctgttcatttttnccctccatttataaaaaggggtcaatttatcatttgctctatagctatttgaattcgaaaaagattccacaaaatttgagttgcacacaggcgctttctgaagcagattaaacttgtccttgtgacacttcagagcttggactgcagtgacttcaggtgcttgtaagattcgtggacctctgctttgttcagtggggagttcttagcccactcaaacaagttttcatacacattcccatcatagcggccaagcacagagccaagtgtcacatcctgaaaatca

SEQ ID NO: 1796 - DNA, 272 bp, Homo sapiens
  Genbank Accession No. F08817
  unsure (1)..(272): n = a or c or g or t
gagtcgaagcatagcttgtttaattttnatacatttntncctttttcctttttttttgtctttnattgaatcttttatggaatccccctttttncatttncattttttttttgcatagggaacaaataaacaaaataatgacagccagagtcactttctgtaaatggtacttaggtaggcgcgtccgcgaaaaccaaaatgactgcgtaatatacaaggttatgattggngtatgatgtgaggggcggggtggggtggggggagagccggcg

SEQ ID NO: 1797 - DNA, 313 bp, Homo sapiens
  Genbank Accession No. F08876
  unsure (1)..(313): n = a or c or g or t
ccaactcagcagctctatttacataacagcgtcgcccacaccccgtggggcctctnacggcttcttggctttcttcacggaagatgagctggaggccgactcccgtcgctttctcgaattgggcgtgaggggtgcgcccaccacatcaatgatggtgtccttggggtcaggaccaagtccgggttcagtcactgccggctcagcagaggccgggcctgggcctgatgctggtgtggcagggccccctagcacaccagcccgggccagtgcctcatgacggtgccgcagcatctgcagctcatactcgcagttg

SEQ ID NO: 1798 - DNA, 339 bp, Homo sapiens
  Genbank Accession No. F08941
  unsure (1)..(339): n = a or c or g or t
aatagacagaagantttaatacatgtnatgctttgccttccatttacactatcataaatnacaaagtattgtccanttcacanaataaaaccatttccagataattttttgacagtatcaagangtacataaactacaacaaacaaatctgtacagttgggaggngggntaatagcagggaagaggtcaaacctccctgtgccaatggngtccatctgcatagcccttgggactgtccaggtcaacagtcacacaatgatgctccacgtaaaatagtcattctcttctgctcactccaaagcaagactggtgagtttacacaantcatctcantcaaag

SEQ ID NO: 1799 - DNA, 316 bp, Homo sapiens
  Genbank Accession No. F09058
  unsure (1)..(316): n = a or c or g or t
ggatttcctcgatacaagtttattagtttattctccatatacaagtttattctcccagaatagcagcaaataaaacttgaattggatgtacagctcctaataaccttgatgtcagagttgtcacttggttggaattattatgatcccccaatttaaatttncttgataaactcagcgttgtttgttttcagtgacaagaaaacatacatggaaaggggacccaagacagttcaccaagatagttcacagccctttgcaggatatgcctttggtgggtgggagcacctagattttagaggactataaaacgccatgt

SEQ ID NO: 1800 - DNA, 259 bp, Homo sapiens
  Genbank Accession No. F09297
  unsure (1)..(259): n = a or c or g or t
gagcaggagtgaaagtattaaaaagctttagagcaggaatgaaaggaaggaaagtacacttggaagagggtcaagcaggggacttgagggatcaaatgcgtggtttgaccttttgacttggggttttatatgttggcatacttctggggtcttgcgttacttctcccctgattcttcaaaaagcacctatttcttaaggatccaaaaaaataaaaaccaatttcattgntgctgtttccatttcttggcaaaaattagg

SEQ ID NO: 1801 - DNA, 229 bp, Homo sapiens
  Genbank Accession No. F09350
  unsure (1)..(229): n = a or c or g or t
aaagaacacatttgctgtttttattggtgccttgcatggcagtaatactgaaaanggagaatgcaaaaaaataaaataaaataaacaaaaaacaaaaacgaaaaacaggttggtggcaacccacatcttttttttaagagcacataaactcctgttttatttttattgtggcatgaatgataacataaaaccaaaancatgaaaatatacaacttatattacactatgt

SEQ ID NO: 1802 - DNA, 315 bp, Homo sapiens
  Genbank Accession No. F09353
acttccttcactagttacgacaaaatttaagaggaataacaaatacaaattttctgttaagaacggaaaggtgcaaactagcagagtcaatactggtaaccagaaggcactaatccaaacacataaatttcaaaagctggttatattatggaataccatatatactggcctttgccagtttgggatttctgcaatagcaataagcctcgtttctgtttccaattataacaacaaaaagatgagttactaatgaacattccacttacagaagtctaggctatgttgataaattgaaaacttatctagactactctg

SEQ ID NO: 1803 - DNA, 346 bp, Homo sapiens
  Genbank Accession No. F09394
  unsure (1)..(346): n = a or c or g or t
aactatggaaaaccatgtttatttttaataaaggatgacatttccaatcagtaaaatatcataaaagtataaaaatgtactaagtacaatcattagcattatgttataggggaatagtggttataactttnccctgtaagatggcacattggatggtcacagttggcttgatttacagaggggcaagagtaggtgaccagttgtaccagttgctccagtttcctaggatttgggactctgtaaaaatgagaaagtcccaggcaaactgggacgggttggtcctacaagaaaaagagcagcatcagagtgttggctatagtttggaacttaggaacaggatcagaca

SEQ ID NO: 1804 - DNA, 218 bp, Homo sapiens
  Genbank Accession No. F09578
  unsure (1)..(218): n = a or c or g or t
ctttatccctttatttccttcttgaaatcnctgaggcagttnanaggagtggagggagggtgggcagggctggaggatgggaggnagcacgtctnatagaaaacgtcaccgagacacaccccagggccagaggcgaacgcatctaaggggtggctgggcaggagcaccagggctatgtacacggtcagggtcttccctggggaggaggcagagggctg

SEQ ID NO: 1805 - DNA, 214 bp, Homo sapiens
  Genbank Accession No. F09684
gctttacataaacttataaggattttttatttaaaggatttaaaaatataacacagtcaatataaacatgtactgggaattataaaccattctttcttctaagcactggatgagatactaaaaacatacagtatcttaccaatagccattaaaataggctaaaatgaaaaagaaaccgttgtaacaaggttactaatcccccaactttcaatgc

SEQ ID NO: 1806 - DNA, 296 bp, Homo sapiens
  Genbank Accession No. F09687
ctcttttaaaaacttttattacgcattgctaaataacattgcatgatgtattgcacacatcatgtggtaaacagcactccacagtaatccatacaatagctcgtacaatgaccatcaaaatagtttgaaaaccgttatagttttcatccgagtgagtgtctttatattcttccatgcaatctgatttcataattaagattactcttccattctacaacaaccaaccgaaaataattttttataaaagcccaaccacaacaaaaggtcattgggacattacgaaaagtcggaaatta

SEQ ID NO: 1807 - DNA, 337 bp, Homo sapiens
  Genbank Accession No. F09729
cttcaaggggtccattcctttaagacaattttggatttctttaaaaaatctattttatttgctatattagatggctaacccaaaattgtttcttgggttattgagtaataagtatggtttaaatggcctaaatactacatattttaaaagccttgatgctggcagagctgcactgaggatctgtgtttttaagaagtgcctgggtcgggtaaggtgaaattctaaactggaggacacattagtcagtttatctctctaaacttgttcatccaaaataggctttttaataaacaatttagcttatacttcaaattaataatccccccacacacattct

SEQ ID NO: 1808 - DNA, 267 bp, Homo sapiens
  Genbank Accession No. F09788
  unsure (1)..(267): n = a or c or g or t
aaggcttctggtagggacattttattttttggtaaagccacaatagatagaaatgccataaaaacaaacatgtaaacaaggtatcagaactttggttcactgaaacatctcacacctaaaacacctgnggtacaaaggcaccttgctaggcgctagacagctaactctgctgcagccactttgatcctagccttggggccagggatggcacaggctgaatggaagggctgggacttcagtcacacaggagtcgccctagtatggtct

SEQ ID NO: 1809 - DNA, 344 bp, Homo sapiens
  Genbank Accession No. F09979
aaattgaaatccacatttattgatgagagatatatacacaaaagttaaaacacttagtgaaatattggattcacaggttatttccagtatataaagaatatccagttattttacacgtgaaatgttacagtaatcagtccacattgtaagaaagcttagaaagctaaaggcgaaaacaaaagacctcaactacccaaaatgtgcttcatcaacaaggcattttctagtagcatatatgagaaacaattcaaaaattagttgaagattttatctttttgcattcattagtctttaaacactatgtgctatagatgctctgtgctacgtgacttcagaccaatggg

SEQ ID NO: 1810 - DNA, 335 bp, Homo sapiens
  Genbank Accession No. F10149
gtatacaaatgtttgtagcaactttattcataataatcccacgctggaaataacacaaatattcatcagcaaatacataaaccaactgtggtatattacaatgaaatactattcagcaatgaaaacaaaaagctacagacacaggcaacagcaaatatctctaaacatgttaagctaaagaaactaaacacaagagtatatactatctgatttaatttatatgaaattctaaatcagggaagaaaactaaccttccagtaacagaaggtggatcagtggtgacctagggctggggagaatgactgcaaacggagaggaaatttattctggtaaga

SEQ ID NO: 1811 - DNA, 286 bp, Homo sapiens
  Genbank Accession No. F10161
  unsure (1)..(286): n = a or c or g or t
aacacaataacaatttttatttcaaaaattaagttcacacattatcttaagagaattttaaaatttactgcattttattgcacttattacataaatatacagttggcaaaacaatttactactaaaattcagattctctctcagtataacgcaaagtattactctgancacctacttcaggcatcactcagtaagtcaaccactaaaagcctctctgctcagattttcctggtgcatcttttatttctcttctctttcatgtagaagtctatgaataatgcccacc

SEQ ID NO: 1812 - DNA, 266 bp, Homo sapiens
  Genbank Accession No. F10182
  unsure (1)..(266): n = a or c or g or t
aatcaaaaccatctttattatttaaagagcatcccgtcatcaggggcacctagacaggagtcccagacagcagaacaatatttacatgggggtcaggaggtgaggttgggtggtctcggggctgagtgggcccgccactntggaagagaggaccctggagggagggtgtccttggacctgtggaccgggcccaagaagaaaaacgtcccatcctaggcccagcgtggatcccaccaccgggntcacctcgggccctggaggctgcg

SEQ ID NO: 1813 - DNA, 226 bp, Homo sapiens
  Genbank Accession No. F10199
  unsure (1)..(226): n = a or c or g or t
acagttccgctcagatattttatttgtntttgtcttttnctttttttggtggggggaaggggacaggttggaagggagacagaaaaacaaaatcaaagaggagaaaaaaaacatgnttctncccaccctccaccacccctggccccaggcctgagtcaatgagggtgaggatgagcacacacagcgggcgaacagcaataacttaggggaggagcgccaggagaac

SEQ ID NO: 1814 - DNA, 263 bp, Homo sapiens
  Genbank Accession No. F10276
  unsure (1)..(263): n = a or c or g or t
gacaatgtcataggcatcgttcatcgacagattgagcttctgcataaggtaagccacagtcacagtgactgancggctaatgccagccaagcaatgtaccaagacaccacagttcttgccccgggcttcatctatgaaagaaatggcctcagggaaaaactgggacaggttttggctccagtgatccgagatggggatttgcttgtatttaaactctcctgcgttctcaaagagattcggcaaattgggggtgacgttcaaga

SEQ ID NO: 1815 - DNA, 277 bp, Homo sapiens
  Genbank Accession No. F10290
  unsure (1)..(277): n = a or c or g or t
gagacagagtctcgctctgctgttaatttttgtatttttagtagagatggggtttcaccatgttggtcaggctggtctcgaactcctggcttcatgatccatctggcttggcctcccaaagtgctgggattacaggcgtgancaccgtgaccagctgaaccaagtctttttaaagtaacttctgcccaatcttgggcagagtttctgagcaaatctgtgctggtgagtcgcgaaacagcagccctggctctcttggtggtccggtgtgtggtggggt

SEQ ID NO: 1816 - DNA, 229 bp, Homo sapiens
  Genbank Accession No. F10380
gaagcatgttttgagacaagttttatttgaaacaaaaggcttatttgaagaaattttcatttgctacaaaaactatttgtagacattctggagatactcatatatgggcaaaagaaattagagcaggcatgcaacagagcagaaaggatgctttatttgcaaaagggtggtgaaacatctaaaaagttgacattgtatatggttacaaagtaaagagtactcttgtgag

SEQ ID NO: 1817 - DNA, 336 bp, Homo sapiens
  Genbank Accession No. F10381
caatacaattgttttatttaacacacatatgtacacaggaacattcagcacacatagagtctattaagtggaatcattaagaaatgtctggagaggcagacattttaattcactcgctgtacacagggagttcaatcatcacattttcatacaggtgtcacgtcatgtcatcttttgcttgtaaattaccaatgaagccacatatgtctctacatatacaaggacaggtccaaatacagtgccagtgaaatcaataaaacattaaaggtgtacgctgggatgacaatgcagagtttacctcagtgctgagaaatctaagctgggatgaagtttggg

SEQ ID NO: 1818 - DNA, 316 bp, Homo sapiens
  Genbank Accession No. F10418
  unsure (1)..(316): n = a or c or g or t
cttctctttttatgtttatgacttcctaaggcacactcagccttgatgagataaataaatcctgtcctatgagacaagccccagggttgctcagaaataaacagagcttctaggtgagaaggagcaagctaaaagaacaaatcaggaagtcccagtgaactaggaacttcgtgtgtgtttgtaacggcagaaatggaatcaatttcagaatttcccaggaagcattatgctaagnttcatacgcccgggttctaaatctaatattctacatatcctattaatgctttccattataaactaaataccattttagttt

SEQ ID NO: 1819 - DNA, 223 bp, Homo sapiens
  Genbank Accession No. F10453
gggattttcaagatgttttattgactatctaatttgaatctacttacaaagagaagaaaaatgtctagtatgtaaagcaatgaatgaaataaatgtttatcctaagtcattattgagtacaaatccacagcttaacaatgtgtttttaacagcaggagagcatgcaactgctctaacacacagggtcagaaataaaaggtaaaagtacatttgttttgtaact

SEQ ID NO: 1820 - DNA, 287 bp, Homo sapiens
  Genbank Accession No. F10466
aacgtaaacacaaagtctcatttatttttgtctgaagcacacaggagctcactcagcacaataacagtaagcgaatcatacaaatattgagaaaaaatgttcctatgaatacatacatgtatattcttaagagtagcgatcaggagtttaacaacaaatgtaaagtggttttctctaaagaatgctttctgacaggcttttgggttggaaatggacaggtaaatcactgtcacataacaggtaagctaagaataacttctgttacccaagtcatttgaaccctgtgg

SEQ ID NO: 1821 - DNA, 284 bp, Homo sapiens
  Genbank Accession No. F10640
  unsure (1)..(284): n = a or c or g or t
agtggcaaagtagtttatttatnatgtttccttaaaggagattaagactcgactccnctcccanccggggcagcccggnaactcagcgcccccctccagtggtgcccagagcctcccagcgccatgtccatctctnttcctcttggcatccattgtggcactcagcccacctctgcctcatttcatgattgtttgcttttgtagtttagaaacagctgcggcaagcatttaggtaaaggcctcaagcagacaacctacagggtgctccgtgtcagtgcaggtgc

SEQ ID NO: 1822 - DNA, 315 bp, Homo sapiens
  Genbank Accession No. F10741
  unsure (1)..(315): n = a or c or g or t
agcaaatcctagcacattattaacaaaaaaatctgtacatttnccatgatacacttgaaagtgaaacaaataagatataaatacagatatggatgtaacatgaaaaagccccccccccaaaaaaacccaaaaaacaaaaaaacccacccaacctgggggtgtggggaccatgcgtgtgaacacagtgccaacataactattttggtggctgatattttttcagagcacttctttatttccaaacattattgttagcaaagtcctggtgggattctacaaagttcttatttgctgtcctttaaagtgtaacattac

SEQ ID NO: 1823 - DNA, 243 bp, Homo sapiens
  Genbank Accession No. F10874
  unsure (1)..(243): n = a or c or g or t
ccagacaggaaatggcactttaatagttggggccagggtgacaggaccaagatggggctggcctgtntcagtnaggaagcctccctcttctgctgggacagggccttgcggcantcctcctccccgcctgaggtcctaggcctgccacaggcagcatgccggtnaggtcagtggcaggagccacccagaagccccgcagatgacggagctgagaacagggacttcacctccacgtgttgccat

SEQ ID NO: 1824 - DNA, 316 bp, Homo sapiens
  Genbank Accession No. F10875
  unsure (1)..(316): n = a or c or g or t
aacatcaatgcttcattctctgagtgctatttattgtctcaatcttcattgcttaaagtcaggaaacaacaaacacattcatatttgtggcaaaacatctacctactcatgacatggcaaatagtcattttacaataacaatacagtacaatatgatcgtnctactttcatggctaggaatgaagttgttgggtttctctttcagagctacccctaaaggcattcactttatattctctgaagagaaccagctaaccaggcggaacatccactaagaatcttccacataaccagaccccaggagcttgcctattgc

SEQ ID NO: 1825 - DNA, 286 bp, Homo sapiens
  Genbank Accession No. F13624
ttttttttttttttgtttcacaaaaagatgtattttcattcatgagtatttacatttttcatatttgtttaaagaatatcatataactgataccttctgaaatgtttcatgcttttaaactcttctatttacacttatctgacatggaattaaaactaaaatggtcaaatacatgataatagaaagcaaccagccaacatagctaggtcttctcttaaatttgctgatcaacattagcagtagttaccttaataataaattattcatttaaatcagtagtaacttt

SEQ ID NO: 1826 - DNA, 243 bp, Homo sapiens
  Genbank Accession No. F13702
ttttttttttgcctgacaaaactggacatctggatgtcctccagtctacttatatactcacagagagaataagtttaaatattaaagagaaaacacaaagatacttggaataaatgtgcatttaaaaccctgactaaaatatcaacataatgatcataattacaatggtaataaaaataattagtacaataatattactttatgagcagcatggaaatttcattcctgatctggaagaataaa

SEQ ID NO: 1827 - DNA, 287 bp, Homo sapiens
  Genbank Accession No. F13782
ttttttttttggtcattaacacagtttattattggcacacttatcagtaaagcatacataaaatacagctgttttttaacacacggagccactgtgcctttacatgtgtggaggaacatattaatatgcaaatggaaaaattaattctcttataaagtttcacataaatacactggagttgcccaaaaacgaaaagtcccataaaagaaccaggtgagagctttacaaaatatcatacaagaaatatactataaaaagaaggatggtcactcaggtacaattagaaa

SEQ ID NO: 1828 - DNA, 269 bp, Homo sapiens
  Genbank Accession No. F13809
tttttttttagaaaatgtcctaaaatgtgcattttattccatatcattatacaatgtttacatatagttaaaacttccttccaaaggaaaaccggtcctttacccaggttggtatggtgggtggtctaaatctttaacatgaagggactgaaaagagtggaaatccacactgattgttatcctacagattgtcatgagctgcacgtgtcgcaatcagaaggaatggaagtctcggaagagcagcgtgcttacagaccttggctttagtg

SEQ ID NO: 1829 - DNA, 318 bp, Homo sapiens
  Genbank Accession No. H00540
  unsure (1)..(318): n = a or c or g or t
gcaatttgtaaattctggtgaatactcaaaattgtagctaaaaacagctatctgaatataggtttaaaacctcaaagacacagagctaagaaatatggaatacattgtatattgctttttcaatagagtagacataaaattgatgacaaatgtttccaaaccctcaataagaactcaaaacatcatactatgccaagctgaattacagaagggtatctaaggaaagaaggacagtggcatcagttatctctaggataaaggggccagtaaaatcaagttggcatttgatgtatacatcttattggggngtggtttttc

SEQ ID NO: 1830 - DNA, 238 bp, Homo sapiens
  Genbank Accession No. H01059
  unsure (1)..(229): n = a or c or g or t
agcaatacatgtttatcatagaaatttaagaacctaagtaatacaaagaaagtaaggattacctttaattaagaacctaagtaatacaaagaaagtaaggattacctttaatcaataaacaaagataaacttttggagggagcatataccattccagtcactangtaaggttttaatattcagattccagaattctgatcaatcaatggctatgtttcacacttctttaaattaaaaa

SEQ ID NO: 1831 - DNA, 378 bp, Homo sapiens
  Genbank Accession No. H02848
  unsure (1)..(378): n = a or c or g or t
ggatnagantttanaggcaagacatttattcactcatgatatatcagtgcaaagtgtgcctacagtatacaaggtaaactcacaactcatcaaaactaaaactttttacaatgtgcaatacatgtagggatattaattcaatatataaatgtcacatgtctcccaaatgtcacccaggctttctgttatttcttaaaatatacaagtcaatattaccagagaaaagataagaaaatcccattattttatcctaaacttatgtatacttctctaaagattcttagggcttgtaagcaatgaggtttaaggcnattttttaggatgttagcatcccggggctgacttngccgggctgtgggaaccccaggnccggagtgg

SEQ ID NO: 1832 - DNA, 408 bp, Homo sapiens
  Genbank Accession No. H02855
  unsure (1)..(408): n = a or c or g or t
ttttttaattttcaaangactgttgatgtcactgtggtttattaggtaaatacaaagtataggctcttgcattttttaaaaagcaaaaccaaagagattagaaaccaagtacacatatcctctttagaagagaaacataaatcagttttaacaattaggcacttaaaaatgtaaatgtaagacaacattatagaagtataaactatagttacactcctaaattcctcctgaaatgtttacaaacacaaaatcacaagcatggaaaacaaatttcctctttatcaaaaaaggaacctgaatttgaatcccatgtgataaaccnatgattaaggtactgggtgggtaggggaaaaagggcttctggaaattttacntatttgntttaaaatgttaggcttttcntaaaac

SEQ ID NO: 1833 - DNA, 385 bp, Homo sapiens
  Genbank Accession No. H03348
  unsure (1)..(385): n = a or c or g or t
atagaaaaacatgtatatatacatatctatatatatttaaggngcaccccttcccccatttgagtatgattactcaatgggaagcagtaatacaaatggaaaaatcttccctcctatattgaggaaagaagataaaataagattaagccatgtttagcactgagtattttaacacatgggttttttgtttgtttgtttgttttgtaataacatactttagattacaatacccaaaattctaaggtcctaatgttaatgatagtatctcaatgtccatttncggtttgtttcaacatgattttctccttttgcctctgtgtcacacgtagtctttcccgctgggaaggtgcaggtttttggatagggccttggngtttgggtaaga

SEQ ID NO: 1834 - DNA, 410 bp, Homo sapiens
  Genbank Accession No. H03629
  unsure (1)..(410): n = a or c or g or t
ctcataaacaannantttattaaantacatgttacataaaagaacatataaatggaccattaaatacattcagtttattttaaacaaatttacatagatacttatttacatttctccattgtattcttaaattatttttccaagcttactaccgataaanggtaatacaatgatcatctgctcacacagatgcatagagaagttgtccacagggctnagtaaagcaccacttcccagggtnacacngcttattagatcttccagcaacaactcatgctgaaggtgctctcttctgaggcagcccttgagggtgaggcttttgctttaggaggttgctggggggttgggttctgagggagctgacccggggcagcggatggggtccttgctgntttgacccgacttgggac

SEQ ID NO: 1835 - DNA, 414 bp, Homo sapiens
  Genbank Accession No. H03945
  unsure (1)..(414): n = a or c or g or t
nnnantntcagacatttattactcaaaatggaaagaggtgagtatgggggatggggtacatatgggagccngggtttggggagtcagcnctntacagtgaggtcatcaggtccntgtgggagccttcactggggacaacacagaagccccatttcaggcccagatcccaatccctcctcaagtaggggacagcagagtataggaagcaaagtggggagcccttctaggagccaatggaggtccnggaaggaagtgggaagggacccagaaaaaggagagtgaagggtttgaggtgggaaggatggntnaggagaccactcggaacantntttaattaaagaaatgggagctagggagagacgattctttaaagccaggggntacagagacacagggagagaggctcaggccaag

SEQ ID NO: 1836 - DNA, 391 bp, Homo sapiens
  Genbank Accession No. H04142
  unsure (1)..(391): n = a or c or g or t
gagtgagcccannagtttattcaatactaggantaagccggtataaaatacatttttagaaanttcacttggagataaaaaatnttgtccccactcctcccccaatcccacacatctgtgctnttctgcctgagttaattcagctttgctgaggcctcctgcaagagcttgagcagggggtcgtcagccctgaggggaaagggtgagcgtgcgctgctgggtagtgcctagggtcacactccaagttctcgatcacctcagccagcaggtggggcccgttccacgcctgagccgggggccttcgaagcccaggggcggttgaagtgcacatgcaggtggtagtagggagggcaggtagttncaggtntactttcgcagatgggtttccctt

SEQ ID NO: 1837 - DNA, 389 bp, Homo sapiens
  Genbank Accession No. H04242
  unsure (1)..(389): n = a or c or g or t
ggaacttaaagttctcttttgccttgatggcttctcagagacatcttaaaacacctgatgaaggatatgaagagagactagagatttagaaaggaccaaggtcctctgataatatgagccagttgtaaggtaccttcagtgccggtcattccctctccacaggaacaggtggtatgatacgagggcaccacaggaggcctctgtggtactagcccctattggtacatggattaaaccactggttgcatgatggggagggatggggggattaaggatggagggactaaattcaagatattaacaaaggancaaagaaacagggcctgatgggaggcagaggatagaacagactttaccagtggggaataaagatncatacccatttacaa

SEQ ID NO: 1838 - DNA, 325 bp, Homo sapiens
  Genbank Accession No. H04649
gcatataccatcattgccactataatagagatagaagatacattaagaaaattcagtttgtatcaataaaacagatcaacacagaacaaggaaacaccatagatatttgtaaatgagatcttctcttttgctactgtgtatatatattcctttatatttatacaaactcacaacacatgacatttcatatttcatatgccactgagaagaggtgtcagtatacagaacataggaagaagaaaaaagcatgagaacatctgcttagttaggaatctgatgaggagagacgtgagagctattgttcctctctctgctcaggccctat

SEQ ID NO: 1839 - DNA, 301 bp, Homo sapiens
  Genbank Accession No. H04753
  unsure (1)..(301): n = a or c or g or t
caaattttatttgtttgtagatgacatgaccttctgtaaagaaaatcacaaagagtcagccaaaatgcaactggaactaacaaacacattcagtttatttgcagaatagantaacagcaccaaaaattagttgaatttccatacattaacaataaataattttaaaagaaaattaaaaaccaattccatttgctaaagaacttaaagtaagaantatttaggantaaacataaaangtgaggtttgtaccttgaaatctataaacattgatcaaantgattaaaaacatgtataattagat

SEQ ID NO: 1840 - DNA, 505 bp, Homo sapiens
  Genbank Accession No. H04793
  unsure (1)..(505): n = a or c or g or t
tttttttttttcctggnctcataaaacttttaaattccatcacattacattcacaccttttgctaaccaggatgaagagccttaaacaggtttaaagagtgcagactgcagttttgttaatacttttttcctctccaagttcttttatgctaacatttccagtggtgggaagtacaagtactattagtcatcttcattctttgcattgccaaagagttcctctttctccgtcttgctctgaaggatgaacaaaagcttgaggtgtacgtatcagaacgtaaactgcaggcacggaggaccaccaacgttcacccaggactgtatccacctttcgccatacgtgtcggcattccaggataacgccttgggtaaaggcattttgtgttcttgagtangtagtacagctcggcctgtgggtagggtgttgcagacacgggttcatcttccctagggcaagttgggataaaggttnccagtttctttttttgggtccccntcctttttc

SEQ ID NO: 1841 - DNA, 454 bp, Homo sapiens
  Genbank Accession No. H04799
  unsure (1)..(454): n = a or c or g or t
tttttttttttttttcatttgttattttcttttatttgtgaatatgtgtggggttgggagactgggtgctagacatgagctgaggtccaggctaggcacagggagctgacagctgcaggacatgctaattggtctgggaaggcctttggaatctagggaattggctttctgagctgaggcgggtccaggcaaggaggcaacaggctgcaggaatcacaaagggaccggggacctccatgtacccaatatctaggtctcatcagtcggagaaacattctcagctcttgggtgaccttgtcctccctcaacacggtacttcactgcatatgggacttcatttgacaattgccacaaaggctttgggcttcagaggcacttttaagggatattaacagtagggaaaggggaggcttggggggagnccagagagttcacccacacaaagccccacact

SEQ ID NO: 1842 - DNA, 484 bp, Homo sapiens
  Genbank Accession No. H04854
  unsure (1)..(484): n = a or c or g or t
cttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagaggaacattcaaggggaaatgggggaaacataatttaggaggaacaaggaacaaaccatgttctncaaatttttttttaaaaaaaattaatgggtttaaaatatatggntttggggacgttcctggcccggggtaaccaagggactgtggattt

SEQ ID NO: 1843 - DNA, 417 bp, Homo sapiens
  Genbank Accession No. H05072
ttttttttttttgagatggagttttgctcttgttgcccaggctagagagcaatggtgcaatctcggctgactgcaacctccgtctccggggttcaagcaattcttctgcttcagcctcctgaacagctgggattacaggcgtgcgccatcatgcccagctaattttgtatttttagtagagatgggtttatacatttttaaagaatggacaatgatgcagatgatttgtgagcattttgatgagaaagtggtgattagaaggatacagcataaatttaattgtaaacatgcttatctagctaacctaatctgtttctgtagaattactggtcatgggagattggatagatgcctaacctatctcaattttaagtaatgtgagcaagtctttaaggtatacataatgataaaatggag

SEQ ID NO: 1844 - DNA, 372 bp, Homo sapiens
  Genbank Accession No. H05084
  unsure (1)..(372): n = a or c or g or t
ttttttttttttcacagtgagcattaaattattattccatacagccctggccctggcccttcttgagggagtggggtttntggggtntgcccagcagggatcctgccagatgatgtccacatgagaaggcaggtgtccaacagcttcagcttcacccagtgccccccagacaaataatgacaagtccagggtcttctgatgtgtcaggccagcactccccttgctgatgggaaaaccggggctcggccagccccactgcatcccctcacatgatgatacgaggctctngcactgactcgccaatagacttgtggggcagcangctggctccgttgaggtaggagctcatcattaactattgacgtcctncac

SEQ ID NO: 1845 - DNA, 294 bp, Homo sapiens
  Genbank Accession No. H05394
ttttttttttagattaaaaaatgcctttatttttaaaatgtggcttaactacatgcaatgtactgagccagttttggaatccaccctgtatcagagtaaaactggaccaaaggaagtgaagtcagggctcctggctgtcactcctccagcaactcaatctacagagcatttcttcagctgttttttgtgacgtgtggtgattcgttttggattcctctgtatgacagacaggtccgaccttgaggaagaccggtagcccacgtcttctgcttttatggggttaatgatatgggc

SEQ ID NO: 1846 - DNA, 302 bp, Homo sapiens
  Genbank Accession No. H05525
  unsure (1)..(302): n = a or c or g or t
ttcatcccttgaggagtttattaggcgaccttggtctacactctcaggagaggagtgcaccagaaataaagccggtgccctggagtccacctggagccaggcgcggggctgncacttaggttggcagcagcccgttagcgcgcantnccagcagcggggacagcntttagccaggcgncnagcgtncgtctccgaggtgaggctccagagccacgcgnagacggcgccgggntccaacagcaccttccagagcagcgacaccccaggaagaggagcngcatncagcagcgnctttatngcca

SEQ ID NO: 1847 - DNA, 353 bp, Homo sapiens
  Genbank Accession No. H05625
  unsure (1)..(353): n = a or c or g or t
ttttttttttttttttttttgcttcacaaatgtcaattttattgacactagtgcacaactaaatacaataattgcaaaggaagtggaacgtgttcaaacagaaatggtgacaatgagttagaactgcagttntttcaaggtactacactattatttaaaaaaaaaatcacaaanagaaaaatgttatcactacaagtagggatttaggaagngagnaaattctgggcagtctgtctagnagggttaaaacatttcatggcatttgtgagttgctgttggagagttgttttttatttgtccaccgtaatctgggcaacatccgggggcttaccttcagctctcggcactgtgcg

SEQ ID NO: 1848 - DNA, 501 bp, Homo sapiens
  Genbank Accession No. H05704
  unsure (1)..(501): n = a or c or g or t
tttttttttccttctgtagtcgtctttatttagagcagaattcagactcagctggtatcccccagggcaaccccaggatgggganagggctggtctgtccccacccacttctccaggatcctcccagcccccaggctgncttttccctccaactgtcagctgcttagctgctcatctggggattggagctggagcatctgtcaaggttgtctccttgacaaacagcttcctctttggaaatggcttcactcaggtcctgcaggtcatcgagcaggacagagagggacccggggaaggaagacagcagatgagcaccagacaagggaaggtgctcgtggttacagagggaaacagggttgggcacagggaaatgagggaatggggagagagggaggctctttgggtccaagctggggcatcncttaaaagaggtttaagggtntcgaaggaccncagagaacaacattcttcntgcgagatttttaagagggagttttctna

SEQ ID NO: 1849 - DNA, 495 bp, Homo sapiens
  Genbank Accession No. H05970
  unsure (1)..(495): n = a or c or g or t
ttttttttttttttggttttaatctattatttacatatttgtaaactgctgttaaaatgctctcaaaaatgttatttaggaaggcacaatttggtagcatcaattttttatttatagttttttctaaacaagatccgaagaaacttccactttaattttccccttggagtacttaaagtacttcaaggttcaatgtcaaatgcagataaaaccccttcattttcaaacttactaagtgttaacaatacatttgatagtgagcagantatgaaagtacagatgttatcaaaagaggaaattcttatgatactaggttcagagnttaaagantttgnaacaaggggctttcatgactggggggaaaatccaaagcttttcttggaaggggagtggggcttttaatactcggggctattaattaaatgcnggaattgagntaacntagttatcccggaccttcnaaaaggcaccgcntaatacagctattgctttnta

SEQ ID NO: 1850 - DNA, 360 bp, Homo sapiens
  Genbank Accession No. H05974
  unsure (1)..(360): n = a or c or g or t
tttttttttaaatcgaggcttttatttacatcataggacaagaaaaggatacaaaagaagtctcttggtcaagcacatcaagcgaaantctaaaactcaatactcagtaaggtntgggcactgatattgaaaaaaagaaaaaaaaagaaagaaaaggtaaaaaggtaatctgtgacacaatccaaatgcttacactccagggnttgagtaaggggaaacccagggcagccctgccacaggggaatgacggctcaggttgagtgacatctgaggattcatcttctgtacccgtgaacctgactcccagggcaacccctagggggttttgacttttggacattagtgagtttaattctttaa

SEQ ID NO: 1851 - DNA, 407 bp, Homo sapiens
  Genbank Accession No. H05985
  unsure (1)..(407): n = a or c or g or t
tttttttttttttcaaaaagtcaaactttattcagtgttatggtagaaatttgaaattcttaggnaagctatgaataaatccttgggcaggtgcaggcatacagattctggggtgcagctgctgagtttaaaagcttcctttggagatgccccctggccccctcaccccctgtccgcctgtcaagaggaggccatcctgggcagcacgttaggggcaaatggcccagatgcccagctgagggcaaacctccatgcctagaggaggaggtcgcctctgggagcaggaggacctgctgggaacccctgcttcacaggctccttttcttgctctccagcacctcctgcagggcagggcaaacagccccagcagcagtagcagcaggccctttcagcagcagggttttgct

SEQ ID NO: 1852 - DNA, 211 bp, Homo sapiens
  Genbank Accession No. H06063
  unsure (1)..(211): n = a or c or g or t
ttttttttttgaactgttaaaaaatttattaaaatgtccaagaagtacattaatgtccacagtgtcagataccacagacccacagaacactgcagctcacagcaaaaccagcaggacccaaagccgttcacacgnacacacactcatatgcgtgccacgacatggcncacgcagcacacacacgacacatccaaaagggggagttcatcaa

SEQ ID NO: 1853 - DNA, 405 bp, Homo sapiens
  Genbank Accession No. H06144
  unsure (1)..(405): n = a or c or g or t
tttttttttttttttaatattgctgagaatgtagggtaagggacactcccatgcactgcaggtagttntcaggctggtaacactgttggaaggatgatttgatcacaacttaaaatgaaggtagcctatgatccactcttagacttcttgaaattcttcaaatcaggcaagcctaggttgactggaaaaacagcaatgatgtaaaccaaacaacgtaataataataaaaaaaatctttttaagaacagtgtttcttcccgggacatagttcagagctttcctctccagctcactttctctgggagaagccataactgtgggtggggttccncaccggggaagggcaggctgacctgggggaccacgggtgcttcgccatgggtgacatgcccacgtgggtatggg

SEQ ID NO: 1854 - DNA, 375 bp, Homo sapiens
  Genbank Accession No. H06166
  unsure (1)..(375): n = a or c or g or t
ttttttttttnttttttttttttttagccaaagaaaacagaagctctttatgccaaatcacaaggacagacaggggaatgtgggggatggacaggagggagggcctgggcaggctgcctgccttttggcaccttgtccaggcgagttcccggacccatccaggngctcttagttcgttcagtcaattccttgacatttgatgtgcctggctcagaactgggtgctggggacatctaggtgcataaagccaggttgcattctgacaggagagagtcaagccaaccggccagggacaggcctgctgctttattcacagatttagatgtcgttccatctgctctcgaagtttgaatttctggatctttcctgaaaatg

SEQ ID NO: 1855 - DNA, 433 bp, Homo sapiens
  Genbank Accession No. H06935
tttttttttttatagtataaaatttttatttgataatcattttgtgactattctgttcagtaatatgcagaaagacattctgaaatctgttaatctctaaacattttaacgttagcttgccatacttgaaagaaactggctagctgcagtttacattccattgtaagcaggtcctcctccaccttcaggtaccacccagttaatattctgacttgggatctttaatatcacatgttttacaatgtacacagttctgaggcatttatctgtaaccgaaatccatcaccttgttccacagggtacaaattcataaactcctggcagggacaggaatcgctggctcggggcccattcatatatcggacagatttctattttacagggtatactggtcatcccttaagggttaaggtgtggccggctgggggcatgt

SEQ ID NO: 1856 - DNA, 359 bp, Homo sapiens
  Genbank Accession No. H07873
  unsure (1)..(359): n = a or c or g or t
tttttttttttttttttttttttttttaatggggcaacgtttttatttctgtacatttacatacaaattttccccaaaggtacaacagatgcgacaccatgcagacacgcagctgtgaacgacagttcaggaactcagcgtaagttgttngctatgaacgagcaccgtcagagaattcccacccacacggtacaggaaacacagtttttatattacaacctcaaggnncagggagggaagtnttcgccgctaggacatgacacaccatactgcttttccaaaacacacgggttcatgaaaaggcgaggtgggtgccttctaggacgagggggacagctnttagttgtgggacctccccc

SEQ ID NO: 1857 - DNA, 444 bp, Homo sapiens
  Genbank Accession No. H08054
  unsure (1)..(444): n = a or c or g or t
tttttttttggnttataataaagattttattaaaaaagtgttaaaanaaataatacatattccagaacatcactgttctgagaaatcacttccctttagaatatgagttctagatggcagatctacttacaactgctctgaggtctttcactagctgatttataatcctatattaaaaaaaaatctatagtctgcagtcttttgacatacttctcaagggtggatatgtggtggaatgcagactccatcaatatgtgtggttttgtttgctttttgtagcttaactgctgtttagnaaatcccagaggaatatgattgaggccagagttacattggttcataaaattcgaacagttgaaggctgtttttgttaattgctggggccacaaccaggaaatccggatgatggggagagaaacacttntttagggtantggttaattt

SEQ ID NO: 1858 - DNA, 463 bp, Homo sapiens
  Genbank Accession No. H08102
  unsure (1)..(463): n = a or c or g or t
tttttttttttttttttttgatttggtaattaaagtttatttgaacacaaaatactttctctgtctataaaattggctgttagcagtagcagcagcatgtcctggccaaggggagtagatttctccagactactaaagccatgtatatagccattcccacttcccatattctgtggatatgtacatgtgcatggtagctagagtccctccaccaggagtatctctctcatggatggtttcttcagggagaggaagaggagacctggggtgaagagctgggatggttttgagtggggcaagccattaggctgttaccttgaagcccagtctctctgggatagctgtactgcagggtgtcctctgaggcccttctctgtactctgtctggctnaggggaatnggggttattttggactcccataggaaaggcacttagcctaagtcaccaaatngactgcttggg

SEQ ID NO: 1859 - DNA, 228 bp, Homo sapiens
  Genbank Accession No. H08863
  unsure (1)..(228): n = a or c or g or t
tttttttttctttctccacacgtttacttttaaaaaataattgtacaaaacagaatgaattcttaaggcatatcagaaatgctgagtcccaggccggggccctgccagaccagggctggnactctgcagttgggagcttgtccagctgccccctctaatgcttttctcctccaggacacagggagcctccggaagcacagtagtccccgtgtgtcaccttaggctgac

SEQ ID NO: 1860 - DNA, 406 bp, Homo sapiens
  Genbank Accession No. H09167
  unsure (1)..(406): n = a or c or g or t
tttttttttttttcacgtggaatggtgttttcattggtgttagttgggggaagaggttaatggttacagagccagggcctgggcaatggggtcaggntctccctgccctcaggngggcagtcggggctcctgctgtggtccgaagcccctcccccattgtgtcctctcaggcagttgatagaataaattccatttaaaatatatgcatttctctctgcttagaaaataacatttacaattgaaaagttaggacttntgggatctgttaaccccactgcctcccacccctgctagccctgcctcagtgagggaaggcgggggcaggagctgcctggggcaccaccgctgtgtatttacatgtcctntgtaacacctnacggagaggggggcccggccagnacacaag

SEQ ID NO: 1861 - DNA, 298 bp, Homo sapiens
  Genbank Accession No. H09241
  unsure (1)..(298): n = a or c or g or t
tttttttttttttgtgggagatgttttattggctttcactttcctcagggagccagcgccccnagncaggtccccacggtggagccgagtgagctgggagggatgggtgcttgcttcgtttcaaagagatctacatatctacagagaggatggagaccagaaaggaattgggaaatggaatcatgagggccgggtcctcatccccaccccacccagcccaccccccacgccaacgcatcagaaacaganttcacaggatgcacagagggaagccagaggtntggggcgggccngggcc

SEQ ID NO: 1862 - DNA, 253 bp, Homo sapiens
  Genbank Accession No. H09271
ttttttttttttttttttttttattggaaaggaaacaatttattatatttgaggaaaatcattaaaatacatgtaatatgtttccaattcactgatttaaaggcatatagatttaatttttaaatacactttcaaagctgttacgcacagttccatagtccagggggtcaatttcttcctctcaaagttagaaagcacttgaaggacacgggattcaaaaaaacctaaaacatcataaaagcccattaaaaat

SEQ ID NO: 1863 - DNA, 459 bp, Homo sapiens
  Genbank Accession No. H09281
  unsure (1)..(459): n = a or c or g or t
tttttttttttttttggcttttaaagcatttaataagtcaaaatcaaataaaagtgatttttaaaaagaataaatttacatatggtacataagcaagacagctgaaggtttctaaaatagaaacctggtgcatatggccccaaaacaccacatgctttgattacactcaggaagcatgagttgcctatttgggtgagaaaatcccatgttacagtgcgatcactgggcacgttttgggagtaattccagccactgctatgtaagtgtttttaattcaggggtgtcttctacgttttcatcttctgaatatcttgtgacggtgcaggtttgaggcaaaactgggcatggaaatgaggagctgttttaggatggaaggattgccaagntgggatgggcttgggcccacagtgggcagtngggttggggggtgggattnttgggacatttaggggaaaaggg

SEQ ID NO: 1864 - DNA, 441 bp, Homo sapiens
  Genbank Accession No. H09317
  unsure (1)..(441): n = a or c or g or t
tttttttttttttcttggttttgtaggcatttatttacatcatatttcaatacttcagaagcttaaacagtgtcaggggtatagcagttctgagaaacagttttacaagaagacataaactaaggggtacccatgagtgcgtctcatccttcctctcccaggccagagtaacaggtatgctgagatgctcttgcccttggccccggggtgctcacctccagcctcgagctgcctcacccagttagccagggggctgcacaggtgtttgcgtgtcctacatgtggcctgtcatgaagaaggtccgcatacgtggctctaggctgtgcagggcaagtcttcccaagggactnaaggaagtcaccctgaaatcctctccccatgagggacctcttcctaagtcagattttctcactgctcctngttccagntcctgttgccatt

SEQ ID NO: 1865 - DNA, 439 bp, Homo sapiens
  Genbank Accession No. H09331
  unsure (1)..(439): n = a or c or g or t
tttttttttgttcatagcagttttattcataatacaaaaaactgaaaacattcaagtatctgtcaatacaagaatggatcaataaactgtgatacactcattccatggaatggctaaaggaacaaactggtgacacacagaacaacaaggatgaatctcaaaaacatttggagtgcgatagaagccatacccaaaaaagtgcgagaaaaaaagataaataatantggttccaagaaatgcccagcaggacagcccagaggcaaagacccacaggacggcgggccgttcccagggctgtcgntcctaattaaggaaacttctgctgggattttgcccagctccatttccaaactattttggggtcagtgacttctttatcccttccatgttgcctcattttgaactaggnttcactgtagtgttattcnatgtctgttca

SEQ ID NO: 1866 - DNA, 489 bp, Homo sapiens
  Genbank Accession No. H09353
ttttttttttttttttttttttttagccattcacctttatttcagagtgttccttggttacagggaggggtgtgcaagaccctgggctctgggggaggggctgagctgcccagtcagagccggcctcagccccctcagccatccagggattcgaaagggtgcttggtctcaaactaggtgctgactctgagggctttcacggtcccttgaacttctgatcctccttttcctcaaaatcagtgctaggactcataagttatggagtccaagattaacaatgctaaatcctcaagctgactgaagaatgccgagtttgactgtgaaatagaaatgttaaaatacagaaacaacccttctattgtgactacctgttaaggtcctgcaattaatacaacgaaagtaccatttttgttgaaaagtaggtggttaggggtttccaaaagccctgggtagcttttgcccacaaaggaaaacgagtttaggacactt

SEQ ID NO: 1867 - DNA, 546 bp, Homo sapiens
  Genbank Accession No. H09364
  unsure (1)..(546): n = a or c or g or t
tcttcgcactgtgcatacaggacgggtccatccatcgcataagagcaaagaatactattgttgccacagggctactggcgcaactacttgagctgcacgtctgcccacaccagcaccagcgancggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggcccttgagaaagatcacgtctacctgcagctgcaccacctaccttcagagcagctggccatgccctttncccggcattttnagagacagccntgatcttcgntggtnttgacgttacgaaggagccnattcctnttcttccnaccttgcattattacattggacggntttccac

SEQ ID NO: 1868 - DNA, 379 bp, Homo sapiens
  Genbank Accession No. H09594
ttttttttttttcaactgaagaaatttatttacttttttctaggtacatagatgacataattatagacaagttttgatacataggaaaacccttccgtccacctctctttatgctaaatgaatcatcacaataatttttacaatttttaaaacaatacacagctttcttgggctgaagcaattgcaagaacatattggtactggtatattacagctacttacaatgtttttaagaacagcaatggagaaaaataagttatttaaatattgatttcatatacagaaagtgcaatgttgttagttgttatataacttgctcgacagtttcttttctctatcaattttaaatcaagataacttgggactcagactattatat

SEQ ID NO: 1869 - DNA, 437 bp, Homo sapiens
  Genbank Accession No. H09959
tttttttttttttgaaataaacgtcgctccattttaataccgtctttagtatcatacacatgtgttcagtagtgagccacccaaagcctcctgccacaggagcagtagtcgaagcacagaggggaccccgctctgctgcctccccatgcagtccagtgatgaggtggatggagtcctccccacagtcacaccccaagcttcctcttctggtggaaataggcatcaaaccttgcttgggcgtagtccatgtacccaaattcaatagatgaaatcttggcttgtacaatggaccacagtccccagaggaaatgagatgcaagggcaaacctattaacttcaaggcaacatttcttcttttataatgggatttttcttcagtactgaggttttcaaagtcattttgggattgcaggcaagtaactgggatttaaattggt

SEQ ID NO: 1870 - DNA, 563 bp, Homo sapiens
  Genbank Accession No. H10482
  unsure (1)..(563): n = a or c or g or t
taaatagggtgtagtaagtttaaaagacccatcttgattttattttcattccttttggttctctgtgtaataatagcaggctacatagtgacattccagttccaagaaggtacatcctgttccattcattaattgctttgattactaggagggtttctgttcagttttgtttttaaatgtcttgctgatctagttctttcagatggaataaccttccagtcccttagagagtggaactagtccatataacccagcttcagtagncaaaagtagaagccgccacatcttttcatttctccaagaggagagtngggaaggttcccatgaccagctgggcagtcaggatttctctagggcattctaatgtgaaataagtgtagactgctgtcaaggaggcttcatcagaagatgtatagcatttgaatgtctaatgataatgcatatcattagaatncaagctttgaaaatttctgattaatgctcatgtattctttatctttgtttttcttntgaaggaagactttcaccactgtctnagtgatgatgctgttgataaggntgat

SEQ ID NO: 1871 - DNA, 438 bp, Homo sapiens
  Genbank Accession No. H10661
  unsure (1)..(438): n = a or c or g or t
tttttttttgactttaggcttctctatagcaatactttaatattccaaagaaaaatatgaactgagaattgtattatctagccaaattgtttttactgtgtaaaggctacagataaacatatttgacatggcaaaaatttagggaaattgttccatgagtcttttttaaggaaactattaaatcattaatttcagctgaccaagaggattaatgggaatgttttgagtttcaaatacatttaaactgtgggaactaaggaaatgtgaggatgacaacagaatgtaaatattatatgtcctcacaaggtagggantgatacaacaaaaattgaggggaaaagggaaaaggaaagtgggaagttcactggatacaataatagttggggcaccagagtgtatccggctaaagctaaggctggacagtccaaggggaggttt

SEQ ID NO: 1872 - DNA, 412 bp, Homo sapiens
  Genbank Accession No. H10779
  unsure (1)..(412): n = a or c or g or t
ttttttttttttttttttttttttnttttttttggcaaacttntttccttttattctgnggaacgtcactaaagtaaacagacatgcatgatttatgttaatttatacatgatgagatttaaggctgaaaatgacttctggggaaactcctactattagtttcagancttctgggcaggggctgacttctcttggcttacttatactncctaactcccagngggcctgaatagacactggccagantttcaaagtagcttcttgaagatggatggngatctgtttagaataatccattcacctgttctgtttcagggnccaaatcaatatcataaaancngggccgggtggggantccaggggattntgctcatcgttcctactaaggggtacagaaaaccagccccaacgt

SEQ ID NO: 1873 - DNA, 231 bp, Homo sapiens
  Genbank Accession No. H10933
ttttttttgcttttataaacattcaaccaacatgttctttaataatctcttctttaaagaacaaaataatcaagtacatggcattaagttaaatgtctctgcacatgaatttccaccttataaatctggtatattaaattgtgctgtaaatagatttgtatattttcttttttgagtactatgataggtgaaatggtatgactataaaaaggatttgtttctttttgtctc

SEQ ID NO: 1874 - DNA, 359 bp, Homo sapiens
  Genbank Accession No. H11274
  unsure (1)..(359): n = a or c or g or t
ttttttttttactgaaatgacttttaatatctcatgtcgcagcaaaattaaaaatatacaaaaagtttgtggtgtacaaaagagtctcagtaaagaggccccagctcgggccacctccccctccccctcctggganagnctcggagggtgaatgggggtcagggggatgagggatggcacagatgtagtaaataccaggaggtgggaccagggaaaaggaaacagaagaggacaggggtgagggcccgttaganngnaagagacgacagggaggggaagaatcacttcggaattgtgctgacagagggagattagccccttcaggcatggcttagtgattcctaggagttccaggggca

SEQ ID NO: 1875 - DNA, 533 bp, Homo sapiens
  Genbank Accession No. H11320
  unsure (1)..(533): n = a or c or g or t
tttttttttgtaacagtaatgcgaagnccatttatttggatccatagtatagtcnttatttgagttttacaaaacatncgaatataaataacctgaaacgtaacaatacacaaaaattggtttcttacacagacataccgggcngtacaaactgaaaacttgagtaaattaacattgttttacattaatatacatagtgaccatctaacatttaaaaacaagtttcaatgcatagcactcgatacttctttgaatctgtttcaatcagttaagagtatgaaaatggttaggatctagggctaaaaataattcttcttctaggccaaaaataaaggcataatatttataaccgggtatcaactttactaaaccacaatattttgaaactattaatgatacctaagggtatttacattaaaaggcaacatgcattgtgttgttttatctcatgactggttatgcacacactttgttcaagggtttttaaaactatattcctactttcaatncagcatctgcaatgtgtctncagt

SEQ ID NO: 1876 - DNA, 268 bp, Homo sapiens
  Genbank Accession No. H11739
  unsure (1)..(268): n = a or c or g or t
tttttttttccgatcaaaatgcttttattagaatactaataaatgcagattaaaaaaaaaaaaacctcacacagaaaaagaggaaaacactcagaaatgtgattacagattaggcatattagaggaaaaagagttcttcagggtatacaaantgtaaacatttgccctgggatttcccacagatggcacagtccacatggactcttttgggaacaaaaaaatgtctattaagtctccagggatagcctctatgacatctgcaaaggcc

SEQ ID NO: 1877 - DNA, 372 bp, Homo sapiens
  Genbank Accession No. H11746
  unsure (1)..(372): n = a or c or g or t
tttttttttttttttgaaggcacacggctttttaatagcagcaagtcaggtgcatctgcctcgaggggctaccaagccatcataccattgtggcaaagggggcatgaggatgaggagaaagcaccaatntgagggcatcctcggtgtccacaggtgagcataaggcaggaggggaagcttccaacacatctggatggcgacacccctggncatggcagacataagatgtgagccccttggtgacacaatcagaggctctttgagaggagggggaggcaaggttggtagtggtncttcagggcactctngccatccaaatgccacatgntttggtccttntagctgcaattggataggaggcatgttccatct

SEQ ID NO: 1878 - DNA, 177 bp, Homo sapiens
  Genbank Accession No. H11760
  unsure (1)..(177): n = a or c or g or t
ggttgagaagtgtttattgtaaaantggagtttntaatgaaantaaaanattatttcataacattctgataccactacacctgagttcgatgccagcatggtttgaaagtgaagctgatacaagttttctaaaggatgttaaaaaactatagtatgaagantgtantaatatttnag

SEQ ID NO: 1879 - DNA, 425 bp, Homo sapiens
  Genbank Accession No. H12257
  unsure (1)..(425): n = a or c or g or t
ttttttttttacaattattattggangttggatttccccccaggagactgtaatattgcaaattagacaaaacatatataacaaagatagctttttatcttcttaaaactttgattagcaggaaaaagcaagccaagtggctcgtccatgctatagtgacttctatggcgccaccacacttaaatgctgccacaaagctttggtaacattgaagaggtccctttctgtatggcacttgtttggctctcacacaagtggggaaacattcaatttgttgaaaatagtctgcttcgtatccaggctgctaaaagcatgttcatttaanattcaagggaatgctttattctaggactttttgtttttacatttctgaggttcacntctcatgtccatggatacagataaggggaacgggggaagggaaa

SEQ ID NO: 1880 - DNA, 370 bp, Homo sapiens
  Genbank Accession No. H12593
  unsure (1)..(370): n = a or c or g or t
cccaggctggattacagtgctgtgancaaggttcactacaaccttgaactcctggcctcaagtgatcctcccacctcagcttcccaaagtgctgggattataggcatgaatcactgtgcctggccatatataatcttaatatactagagatgtggcgataagacttggcttcatcttcctacttcataacatcttagtgccaaaataataaacgctgcatattgcaaaatagccacctgatttcaatcatgggaatgtcttggcacactgctgggcaatggaaacatttcatgggtgaggaaaattaaggctgagggcaagtgcattagttttctaatgctaaaataaaatcgacaaggtaggaaggcaa

SEQ ID NO: 1881 - DNA, 420 bp, Homo sapiens
  Genbank Accession No. H13532
  unsure (1)..(420): n = a or c or g or t
gcgttcctgagtttatttggggcacacccggacgagggccctgcacctagaagaaggntttgggcctcttgggtgtgaagcgtggcttgnnctgacggcgcaggncccggtngggcagcgggaacttgancttggagtcgtggaactgcttgacagccggccggggcactttgctggccgcgatctcctccaccttcatgatctgaatggagtgggctcgggcgcggtgccgggcaccantgtctcggtagcactgggtgacagcgcctgcggtgggtcangtcccggtattcccggtacatgttgtggggtgccgctccgggagtcataggcgcaccaagatcccgaagttttttcanccgcaggggggactttctcaaaacaactngcccacagtagacaattttcccntgaagattt

SEQ ID NO: 1882 - DNA, 423 bp, Homo sapiens
  Genbank Accession No. H13696
  unsure (1)..(423): n = a or c or g or t
acagcgatgtacnaaacatgtatttgttgacatggaaagaggttcacaatgtacagttaagtgcaaaagcagattataagaaaacagtgtgcatagtaggataccacggtggcaaaatctatattctatatattcatagaaaaaggcctagaagaaaatataacagtattcaccccagagagtgggatggccaatgagtcttctttctgcttctattttctaatctttctacaatgtttgtgtaggtcagttttcctgggnttgcttttttttttttttttttttttgaggcacaggtggggncatggggagtcacggctctcatgctgccngtcaaggaggcatggggacttgcctacaggggggctactccccagcaggctctgcttaaggaggattctgggggnatgtcctgaggncccc

SEQ ID NO: 1883 - DNA, 469 bp, Homo sapiens
  Genbank Accession No. H14372
  unsure (1)..(469): n = a or c or g or t
tttttttttcacttaattatacatacgttttatttaaagaaaagcaaaacacacaaccacagcatttcaattaaggagcttagaaaaatttcaagtgcgttcttggttctccagttaccattccaataaaaaactttttaaaccaaagttaaaattaagtgaaaaagaaagaagtcccagtaagcagaccgaacaatacaaattcaaaatactactctatcttcttgtgttcgttcccaccaaagtgtgctgtttaaagttccacaactattatcttcctcctcttgttctttagtgagttctacaaaaacctgttccaatgttgcttgaggaaaagctatattcttcaatgggcaaaagcatgtttaggcttcttccagcttaaaaaaaggttgtggaaagggggactggaacatcttccntaggganttttntagggcnaaataggaggaaaaacttcccgacgggt

SEQ ID NO: 1884 - DNA, 353 bp, Homo sapiens
  Genbank Accession No. H14617
  unsure (1)..(353): n = a or c or g or t
actagaaaagaaagttttgtgtggtggtttttctctctgaaagggctggcttataaactattctacatgactttcaaaaaaaaattccacatgcccctttgcaaatctaatctttttcagccgggtgcagtggctcacgcctgtaatctcagcactttgggaggctgagggggtggatcacgaggtcaggagatcaagaccatcctggccaacatcgtgaaaccccgtctccaccaacantacaaaaaanttagccagggtttgggtggcgggcgcctggtaggtcccagccattcagggaggctnaggcagaagantgggtntgaaccctgggagggtnggagctgggcagt

SEQ ID NO: 1885 - DNA, 422 bp, Homo sapiens
  Genbank Accession No. H16098
  unsure (1)..(422): n = a or c or g or t
tttttttttttttttttgggggaaagatctttatttactgatacagaacaatctgtgagatggtttagtctttaaaaaatggacaactgtgtatattatgctaccatttctttaaaaaaagaaaaaagaaaaaaaaagtaaagagaaggantcaaggattgagaaaataagccacagcctgggaggaaaatatttgcaaaagacctatctgataaaggtctgttatacaaaatatacaaggaacacttaaaattcaacantaagaaaatgaggcaatccaattaaaaatggggcaaaacctctaacagatacctcaccaaagctatacaggatgggcaaacatatggaaaaggatgctaaattcatatattattgggtggaactggcaggatttaaaacaatttaattaccacttacatacc

SEQ ID NO: 1886 - DNA, 571 bp, Homo sapiens
  Genbank Accession No. H16251
  unsure (1)..(571): n = a or c or g or t
ttttttttttttttgtggntcataaatacattttatttcattagaaatgcataattacagtntttaagagcatttcccctagaaaagtaggtcagcaataccccatcgganccgagagctgggctttgcaaacacctgncctcatgacactgggacagagcacacagcaaagggctcccgtactcangacactgggacagagcacacagcaaagggactcccgtctcatgacactgggacagaggcacacagcaaagggctcccgtctcatgacactggacagagcacacagcaaagggctcccgtctcatgacactggacagagcacacaggcaaagggctcccgtctcatgacactggacagagcacacagcaaagggctcctgctactcccctgggnttttttttttcaaattttcttttttgttataancaccatagcaanttaaaaaaagctgtttaaacagaaaatatcatagttcttgatttccgngcatatggacggtctccgcaccgtgcctccctggtgtcggcaccaacagnagggctnaacgaaggggtntcggcttgg

SEQ ID NO: 1887 - DNA, 471 bp, Homo sapiens
  Genbank Accession No. H16768
  unsure (1)..(471): n = a or c or g or t
tttttttttaatttataaaaatgaaaagtttatttgtctcatggttctgacaggctgtacaagaaacatggcaccaacatctatttctggtgagggctttaggctgcttccactcatggtagaaggcaaaaaggagctggcatgtgcagagatcacgtagncaagagaggatacaaggagatttccaggnctctttttaacagtcagctctcatgagaagtaatagaggaagnaagtcacttactactgagagagtggctccaagccattncataaggaatcaaccaccatgacacactagggcctcacctccaaaactggggaatcacatttcaacatgaggatttgggaagggtcaaatatccaaactataggcattctacccctggaacgcctaagtatcctgtccttctcacaaggcaaattacattattttattcccattagtttcccgaaaacttaacttgtttt

SEQ ID NO: 1888 - DNA, 253 bp, Homo sapiens
  Genbank Accession No. H17472
  unsure (1)..(253): n = a or c or g or t
ttttttttatnttaattggaatcagacatttaatggcataaaaacattgcatatatggctttgctgttccgaatgtcatgaacttaaaatccaaatatgacataagcagttttaagacttattttggccagcctccccaatcccaaaggagatttaaaagtaataatgtaaaaaagttaaggtcaaggtgttttaaaatcaacatctcaggctaatgactaaccctttgtttcctgggggacttctgctctac

SEQ ID NO: 1889 - DNA, 245 bp, Homo sapiens
  Genbank Accession No. H17476
tttttttttgctttttgagactttcaggcagcaaaggccttctccttccagacaagcctgggtatacacactctggccctccacccacaaaatgcccccaggtgaggctcttcagtacccttcggtgggcctcggagaagatcagtagagcggatccatgatgtttgtgatggaatctccaaggatagtcttctcccattccagcagctggctcaccaatccccgatttggacacatgttgtttt

SEQ ID NO: 1890 - DNA, 462 bp, Homo sapiens
  Genbank Accession No. H18412
  unsure (1)..(462): n = a or c or g or t
agggagaagntnctttattctgggatctgcgtaccaggntggctggggtgctggantgggaaggggaatccaaggagcaaaccaagaaggtcctagggccagcctaggcctccacggcccggcctttgatgacgcggatgtggcggatgacgtcctggatggcttcanatgttntgccctggcccccgatntccggagtntgcatattctcattgtccatggatgccaggacanccttacggatggangtngcataggagtgcagcttnaggtngtccancatcatgcagctggccancanggtggccgtggggttggcgatnttcttattggcgatantcttnccggtnttcctcgtagctntttcaaacancgcgtacacatggccatanttngccccagccacaaaggcctggggcccccgaccagttccgcgnagacatttttgacgattttnccata

SEQ ID NO: 1891 - DNA, 503 bp, Homo sapiens
  Genbank Accession No. H18442
  unsure (1)..(503): n = a or c or g or t
tttttttttttttttttttttttggcaggccaaaaccctagtttatttcagcatcagcagttatcttagccatcaaaaaaataaactctaccaagggtnacggaagntctacagcaaggctaagggctcgccagacggnaancatcaggggtgcatggtgggcactgccagggcaataagttaggaagcagcagggctggntntcgggtttgggccgggcttcatttctgggcaggcatgaggtcgtcgatggcctggccctgctccagccgctgctccatctcgatgagcagcttcactccgtccaccaccatctgcaccagctccacctttgagaaagcccagggcgttcagcgtttgggagacgtncgaaagccccccggnccaccgcagtccgtnttccacaccgttntgtggcctncgtttttttgnaagttcgcagcctttttaaggcaccttccgagganttttttaatgttttgcccagggttggnaagtttttt

SEQ ID NO: 1892 - DNA, 400 bp, Homo sapiens
  Genbank Accession No. H18950
  unsure (1)..(400): n = a or c or g or t
ttttttttttttttttgattaacattctttatttcacagtatttttgatcagaagtcttagaaatcatgattcatctggttacaaatcccatgagtttctctttgaatgaacctcttgcttccagtcccatacaacgcatctcccaccagccccagtgggttgtaactgtgattcaacactgagtgctcgcttggaaaggaggtggagctcaacttccaactcagagggcctctcccactgctctcagggaaatgcccatgattcacttatgctgtatcaacaacaagtgcagctgggcgctgcctttcccagctgggccaagcggctcctaggggggaatctccaccctcaggagggcttagggaaaggggaaggtntgaacgagttcaggggcccngg

SEQ ID NO: 1893 - DNA, 309 bp, Homo sapiens
  Genbank Accession No. H18997
  unsure (1)..(309): n = a or c or g or t
taaggttcattaatggtnttttttcctgattacaaaagcaaaacctcattttttggtctttgaagaccatggagtatgacttctaagagcaaacattaacatcagatttgtatgtctcactacaaaaagaacccatcactgatgtaagacctactcatgatactgaagtagattttttaaattaaaaaataaaagtagtcatttaaaatggaggaattgtagatgagtatggaaaaatccattcacaaagttcactatttgcattttctaaaaganttttatgtaataaaatagaaaactaatgattta

SEQ ID NO: 1894 - DNA, 466 bp, Homo sapiens
  Genbank Accession No. H19089
  unsure (1)..(466): n = a or c or g or t
aagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtggcgctacccaactggttaaagccaatgtgatcttttatggtgaaactcctaagaaacaggtggttttgctggaaacttggtagacccttaattatagtggtgctaatgagcactactgttaatattaaagccaccnttattttttattcaaacatctgaatacatttaccaaggctattgtgagggccttattttgaggctcnattttgagggtgatgttt

SEQ ID NO: 1895 - DNA, 218 bp, Homo sapiens
  Genbank Accession No. H19504
attaggaagcaaaaaaatgtacagttacaagaatcattttccaaacagaggttaaatatgagctgaaaagtgtaaaaaaggaagaggaacatcactttacaaatcattaaattaaacaaataaacaaacagaacccaaagaaccaaccccccatgctgagttctctccttgtgcaactctggcaaaatgaggaacaggaaaatgaagtggggccgtgg

SEQ ID NO: 1896 - DNA, 407 bp, Homo sapiens
  Genbank Accession No. H19562
  unsure (1)..(407): n = a or c or g or t
gcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggttttccggctgcaccgcggcatgaatgtgcccttcaagcgcctgtctggtgtgtctctcctccagtggtctttggagaacacacactgctggtgacggtgtcaggacagagggtgtttgtggtgaagaggcagaaccgaggtcgggagcccattgatgtcttgagcctgccggaggcgaaggggttcggagaagcggattttgggtcctggggcctctgttgatgaaggcaagncaaaacttttccggt

SEQ ID NO: 1897 - DNA, 395 bp, Homo sapiens
  Genbank Accession No. H20543
  unsure (1)..(395): n = a or c or g or t
ttttttttttccatgtattatagtttattaactttctttttcacgctcactggggttaaggtgcggaaagcatttcacagggagtcttaaaaccaaattaggattgccaggtaaaggctgcacaaggaaaatgccttatctctgaagcccagagctggcaggggagggcatgacccagggactccaccctcctgcaaagggaaagggcatgctggagaggcatggggacccactccaactcactctgggtgctgtctgtagttctggaagcttggtggaggatttcctgctcaacttagagggtgggccaatggggccaggncggggnaaggtgagggttggaagggcagaaggaagtnacaaaggccaccttcagcacagcagttagaaggaag

SEQ ID NO: 1898 - DNA, 473 bp, Homo sapiens
  Genbank Accession No. H20627
  unsure (1)..(473): n = a or c or g or t
tccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttggggacagtgggatactggcaacagcccaaggaactcttgggttattccgcacaagctgctgggtaggantacattagccctcnggtttttccaggttcaaccccngtt

SEQ ID NO: 1899 - DNA, 449 bp, Homo sapiens
  Genbank Accession No. H20989
  unsure (1)..(449): n = a or c or g or t
ttgtttattgacatacaggtaggctctatagcaacaggcctggnggtnctgcagtagtgggggaaaatggangncggagggtggggncaggtncaaactggagaggcctagagagctagagangcaagtaaggnccagggcagantcggcttcaatggaacaacagcccagtgccctaaggcccctaactcttgctggctgtttcttgaccccaagccagggttgggagtcctctgggcatccatttttnctaaagganctggacagagtacacacaggaaaggaagctttcaccctcttgccatctggctccaggggcctccagtccagcattcctccttcttcccttnattgggtggggccacatgatgggcagccaggctctgggctgttcccactagagcaggctgcaaacacagccatttttcagtgaggcttgatcttcttna

SEQ ID NO: 1900 - DNA, 406 bp, Homo sapiens
  Genbank Accession No. H24077
  unsure (1)..(406): n = a or c or g or t
tttttttttttttttttttttttttaacagaaaaccggacaattnttatttattttaaataagaagtcataatactattaggaatagagagcaagatataaaatcatatcaacccttttagataaatacaaaggacaaatgaaatacacaaaaaacantatattttaaaaatccactgttagtttttngaaaaagaatttngacagtttccattangncactacatcccactattccatttttnggaaggacagatgcttgaggccataggttaccagctcttgtttggtctttaaaaatgcaaggtaagttgctaacattttcaaataaggattttcaacataactctggacaatggccacgggacacacagtttgggctccntggtacacgtaccnggggggga

SEQ ID NO: 1901 - DNA, 386 bp, Homo sapiens
  Genbank Accession No. H24081
ttttttttgcaacatttaatacagtttttatttgtttaatttggtaaatgtagaatgtaatggtttcaaggcaaaccctggactacttcagtcacaacccaatagttaacatgattctgaagaacagtcttatctgcaatatctacccacttctaaacaaacacatctatagaaatccatgtacatatatattagttttcaacaagtcaggattttcaacaactctaaaatttcaattttatattctggaacacacttcaaaattatccacttgatgtcagggatataaccataggggaggataaaatttcatgccaatgatactcagggtttttttttttaaagggtaaatcccaatattttgatccattccatggctaccataa

SEQ ID NO: 1902 - DNA, 449 bp, Homo sapiens
  Genbank Accession No. H24269
  unsure (1)..(449): n = a or c or g or t
tttttttttttgtcataataaactgattttattagaaaaaggcactttaatgccaactgctggaaacacgcatagtaaatacatttgcacaaccaaacacagtgccctccagggggcagngggagaagaagagtaggagagggnnatagttnttggcttaacaaagaagagaagagcgaggancggnccaggggangtagttaggtcaagtggatggttctntacccaggacacagcaaaggtcctcaggcactgattcacattacccaaagttcaccagataataggagttgtttccgtgggctgacatttcttaggccttgccctcaaacttgggcagggaggggagggcaagcttcgttttaaaggaaggggagagggggagggagtttccngggcaatttgggcctagggggtttgggntttgaggagagatttaggtttgaccc

SEQ ID NO: 1903 - DNA, 414 bp, Homo sapiens
  Genbank Accession No. H25124
  unsure (1)..(414): n = a or c or g or t
tacagatttattaagcctgatgtagaaagacatttaacagtaacatctccagaaagcataaaaagagcacttctattcagtcttgtgctttgaaaagctaaatatatttttatcatataaataattcttttcatgttttaagtgcatctgtgttttttttcttctctcctttaattttcatttttcaattggccaaagcagaagtcgacgttgactgaaatgaagccatttgcaaagctaatgggtgttgagagggcatgtctctgctattccgtatcaggctagggtttcagggaaggggggttcaataggctggcaggcatttaaantgagggggacaggcctccnggccaaaatccataatttggaacacacccgggggccccccaatgtcaggcagtttgggggtttccc

SEQ ID NO: 1904 - DNA, 325 bp, Homo sapiens
  Genbank Accession No. H25551
  unsure (1)..(325): n = a or c or g or t
taatttgtttattttcaccgttctgcatttcacaaactttccacaatagattttaaactctaaggcatttgaggagcaaggagcgagaaaaggtatacaaccatagtaattctctctgctgccattatactaggcatttatagtatcccataactgaatgcaagaattgctcctgtataaatgggaagaacatggnttaaaacaaatgagaaaaggggcaatgtgctaatatgttgtctgcataattttttaaaggcataaacataaatctgggaaaccaacatattacaagggttaaggnatgggntacttcttgttgggtagg

SEQ ID NO: 1905 - DNA, 206 bp, Homo sapiens
  Genbank Accession No. H25836
tcttctgtaatatgtgtcaaagatattatgaaaaaaagattagaagtcctttcccccatttttagtaatcttgatattatgaaacaagtgagtactaaaacaaaaacaacaataaatatgagcactacagcaaacatgacatactgtaatagaattttattgaaaaaaataacacgtacttactgaagtttttttttttttttttt

SEQ ID NO: 1906 - DNA, 375 bp, Homo sapiens
  Genbank Accession No. H26417
gtgtgtccctccagatccctctccagccctagaaacctgagctctataaatgttgcctctctccactcatcttctctttggcttcaggttgagttcagccaacagatgcccctgtaggatttggacacagggagccaggggagaggggcatcagctgcctgggttagcagggctggtgatgattcttctacctatgactctcagtgctgttgcctcttcctctggatcttggaagcttccatgctgaggtctgaaggtggctccctgcctcccactgatgtccttagaatcccatcctcacctaatacctgggaattgaacactggcctttcttagaatgtcatttagggtctcgtttcaaattcccagtatggc

SEQ ID NO: 1907 - DNA, 348 bp, Homo sapiens
  Genbank Accession No. H26763
  unsure (1)..(348): n = a or c or g or t
ttacacacatcagactgggggaagaccattgacatagctgagcaccaggtagggtntcctgggtattcgggcatgagagcagcaggggcctcctgacgcgggcaggagaaacatggcacccaccaggaggaggaagaggaggaagaggataaggaggaaggtcagaggctgcctgggatgcaggatcgggggcccctgggattcccctccagcctcacatcctgggagatgaggagatgcttgcctcttcttgtcctgaggcttccggagcagggagtttctttgggtgacgtgctaagcntttctnggtggcccaggccaganttccagcatntcctnttcgggagt

SEQ ID NO: 1908 - DNA, 481 bp, Homo sapiens
  Genbank Accession No. H27188
  unsure (1)..(481): n = a or c or g or t
natanttngaaaagttttattgaaaaaaaaaatgnacaaataagtncttggattganagcaacaaaggctcangttcccccttccctccctatctttgangaactaaaaaaggangaaacaaaacaaaaagttcatccccacaacgccagacacgatgcttcttgaccagagtctgcccagaagcccctcctggggagctccttctcaatccgcctcactgcgggccagggncattctggggggngcctgggncccagggggctgcagcacctaggttttatagttggggagaggttggggataggagctgggggagggcagctgagggttttttaggtntcagaagaggggctggtctgacccccctaggctcaatttgggtctcacagggtnagaaggtacccggggttataaaatatggaatactntttttnagggcaggcttnatctgggggctttcaggggcaggcagatganttt

SEQ ID NO: 1909 - DNA, 256 bp, Homo sapiens
  Genbank Accession No. H27330
  unsure (1)..(256): n = a or c or g or t
tcgggctatagtttaattacgacaatcatgaaattattgcaaataaacaaagaatgtaaaactcccttcctatttgtctagcactactaaacttgagaagtgtaatataattatatagactganctcagccagggactctaagcacttgtgtgggctgtgatatagaaggattactaataaattgagcccggtntgggggtcacattagngcccttcatcacattaaatgatatagggcaaccggggcttagtggg

SEQ ID NO: 1910 - DNA, 232 bp, Homo sapiens
  Genbank Accession No. H27442
  unsure (1)..(232): n = a or c or g or t
agtganagttttntacactttattatgtacattgttggaaagggaggccacctggngaaacttctgcactggcactgtgttcctagagctccttctatgcggccctcccaagtgatttaatttcaggctgattggactacgaattcacaaggcagaaaagtcaaggtcatttggnatctggagacaggagaactcaaggaaccaaaagtactgttactctaagtctcagaaa

SEQ ID NO: 1911 - DNA, 429 bp, Homo sapiens
  Genbank Accession No. H27897
  unsure (1)..(429): n = a or c or g or t
aatgatcaaatatttttattatgtttatttgaagtgagatgatggaaaagatggcctggctgattttggaccgagtggcccatcacgatacctgaacaagcagttgtgagggtgggcctggcacacccctgggatgtttacaggagcatctggtccagtcctgtcttatggctgtcccagctccagctctcgaagagtctctctgaggagcagggcctgggagctgggcctgcaaagccagagctaccactagaagaagggctgggctggagcagggccagggaaaggagacctntccagggggacaaggttgcacgcagccttcagggtgcagccagaacctgccggcagaccccagggccaccgacgagggcaggccttaccagggattnacacctgggtttttnagggtnaccttttatttcccct

SEQ ID NO: 1912 - DNA, 402 bp, Homo sapiens
  Genbank Accession No. H28333
  unsure (1)..(402): n = a or c or g or t
cccggacaattatantttattnntcatatatatatatntccccnnatatatatatacatacatatataanggaaacaatttgcaaatntacacacctgacanacccncatatacacacatatgtatgcatacacacagacagacacacacacccgaagccccccgccaggcccgttttccatccctaagtaccattctctcatttgggcccttctagggttggggccctgagcttggtttgtagaagtttggtgctaatataaccataggctttaatccccatgaagggacagtgtaggaactcatctttgtctgntccccgntggcctttcagttttaggtgatccatcaagggggggtatgggggnggccaaggtggaacaggggggattgaggggtaat

SEQ ID NO: 1913 - DNA, 347 bp, Homo sapiens
  Genbank Accession No. H29565
tttttttttcctaaaaatgttttattttaacaaaatgctcaaatatctgaaattgggcaaaggtggagggtgggcaagctggctgaggtgtcccaggtctgtggctgcctagctgggtgaggggctggtgagcagctgctccagacaccctggacttcctccaggccccggtagcccgcttcagaccccggggaaggcagcggcaggactccaggttgaggtagagcaggcccgggcagctgctgatcacagagctgacagtgcttggtgtgacccgggtgcccctgaggttaagagagcacagggctgggtttgagcccccaggggtgcttaagaaggcagccagg

SEQ ID NO: 1914 - DNA, 439 bp, Homo sapiens
  Genbank Accession No. H29568
  unsure (1)..(439): n = a or c or g or t
ttttttttttttttttttttttttttttggagctttccgcgggagacagagcatttaatgagagcaagagctggacagtntggtcaggaatcgtcccacccaaggaaccagacacatactcggtccttgatggggtttcctgaggctctcatactttctcctgccctggaaaatgccatccaggngctcatctctttgctactgcctctcttccagagcagcacaagaaggaaataaaatggacttgcgggggaaagaagatgcttgtctctcatgtctgtctcttacaggggggcttctgaagattcccacagcctctctggganttgttgccccactttggggtntttgtccgagtaacttcaagtaggattgggcccacgggcagggggttntttgctgagagatcaccaagcgttgttcaatttcaacgatcctt

SEQ ID NO: 1915 - DNA, 333 bp, Homo sapiens
  Genbank Accession No. H30270
  unsure (1)..(324): n = a or c or g or t
gaaatcatttnntgntctttaatcatagcaaatgtgtttttacggtagtcataaaatcaacattaccacatatacaaaggacaagacaccagtttggcatacaaaaataccatatattaaaattgggttcattggaaaactcaggactggctaagacaccatctataacagagagagcaagcaagantgcttttaaggacattcagatttataaacaggcagcttgatatcccctttacgaggtcaatatttgggcaacatttggggccaatatttttctacacagcccggcaggctcatttatctgtagggggctatttgggncccttaaaa

SEQ ID NO: 1916 - DNA, 390 bp, Homo sapiens
  Genbank Accession No. H38240
  unsure (1)..(390): n = a or c or g or t
atcttanttaaaacctttttnacaatttattncctgttgnnaanctttaaaaatgaggtnctagctaagtgcagggtttcagtggtgaaattttgaccatgtgaacacataaataaatatttacagtctttggcaaaacacatgacgtttcatcaacctatacgataaatttgtttagaaaancataaataatttacaaaaaatatggtacattctaaatattcacatcatcgtcactcccacaccattgtacggttgaccccacaacacagaaacaggaaaacctgcacgctgttgacagtcgctacatttnatgaggtatcccaacgcttcgttggtctcggggantacaggctccacaggcaaaaaggtaaaaagtgcaggcaaanc

SEQ ID NO: 1917 - DNA, 442 bp, Homo sapiens
  Genbank Accession No. H38246
  unsure (1)..(442): n = a or c or g or t
antctaatntttgttttaattggacccttttcagcctggggctccccccagcccccaggccacagcctgnaggtgtctctggccagccacagcatccagctgctggctgccagatctgtccagttgcccagaggaagaagggtgggtgggcagaaggaaggggctggagacagatcatcagccttcccacccaccccgggtggncncctccctgtctccagaaaggtggcccaggggcgccagtccagtcaccccagaaatatccaaggcactggcgggggggcaacccttnacagccagccccgcccggctatgtggctgttgtgtgcctgttggtcagacgcccggccacccngttccgagggccatcagtggggggctggnctggggccttccagttgtcccttttttagttgcagaggttnctggggccgccgccgtt

SEQ ID NO: 1918 - DNA, 366 bp, Homo sapiens
  Genbank Accession No. H38568
  unsure (1)..(366): n = a or c or g or t
naaantnttaaaacatttttattctgtacaatatatatgtgtatttaaatatatatacatatgtatatatatatntctccncagagaaaccttagccaacaaatccctgagtccatgggaacccaggacactaacaaagggaaaggagagtccatgcctaaagagtaggacatatggcaacatctttccctttcctcctgggtcccctgcaacagagggaagggcacagtcactacaanttactaaaacgngggtttaggtggggcaggaaagtggggtgagagtgggtagggntggggaactcaggatgccaccagtctggggaaagtaaaacatttgntccagcatggaaagccaacatggacc

SEQ ID NO: 1919 - DNA, 494 bp, Homo sapiens
  Genbank Accession No. H39119
  unsure (1)..(494): n = a or c or g or t
tcagagcatncntnttttatttagcaacaatggcagtatttcatgagaatgagctgcacaatagtgtaaatgccattttctgcacacagcctgggagcagatggttacagcgacagagcccagaccccacagtcctcccctgcccttcctgacaggctctggctacttctggcctcattattgtctcagccacagcccaggtcgctgggccagaagggagggtgcaggctggttccgctgctcaggctctgtcatcctgcttcttccttctcaaggccacctcgggagcagctggcaggcaagaatgcccccctcacacacagggaacccaagtccctgctgantcaacctcttcttttttttttttttggagaaagagtctcggntctgtcantcaggttggagtgcagtggcgccatttgggttcactgaaagttccgttnccgggttcgcacctttttnctgcnaaggntcccgagtagttgggttaaagg

SEQ ID NO: 1920 - DNA, 379 bp, Homo sapiens
  Genbank Accession No. H39627
  unsure (1)..(379): n = a or c or g or t
ttagcagttcanatagtttattcagcaatataacaggagagaacctccattgtaagagacataaggcagatacagggtgcatctctggggtacattcttcatacagactaacaaataacttcaggtttcacaacatgtagcaagtatgatttgttgcacaccaacagccattcattcctcacgttttccttgctaaaagagccctggtcaggcacggtggctatgctgtaatcccagcactgtcggaggtcagggcaggtggatcatctgaggtcaggagttcaagaccagcctggggcaacatggtgaaaccccgtctctactaaaaacacaaaattttgccagacatggtgggcggggcacctgttaattccccact

SEQ ID NO: 1921 - DNA, 378 bp, Homo sapiens
  Genbank Accession No. H40149
  unsure (1)..(378): n = a or c or g or t
aataaatgtttaatattaatcattcccaaactgacaagaacacaaaaataaaatgcaaatacagagccagctttgtcacccaaatctgtgtctatttctgatagtccatggaatgtggttttcttggaagccagggttggtctccccacagaccccagggctaaggtcaccagttagggaacccagggacttgggaaggcagagctgttggagctcttccatcagggatctgactccgcaaaacgacttgatgaatgcaattgggcaaactcccatgttcgggacttcatatgcatgagccgttgggacagaggggtttcttaggtatatacttttaatgcatgtttatgtngcaatcttgttagtgggggtatacaa

SEQ ID NO: 1922 - DNA, 327 bp, Homo sapiens
  Genbank Accession No. H40424
  unsure (1)..(327): n = a or c or g or t
ctgtatantttnncttnttttttctcttgtgatttggcacttaaggcttaagcgcnaaaaaaaaaggcatctactgacaaaatatgggacttgtctgtnatgcatggtaagtgggctataaaatccagggagggggtttcaagccagaagaagctactgacaaattgacttgtccttatgttaggtggggttatgagggggagagggagggcacattctgaggtgctgggggaaaggggttgagcttaaccttgttaatgtagggcctgtggggaatgggatgggtagggagaagagggtatgggatgtgggtgcagggtaggggct

SEQ ID NO: 1923 - DNA, 443 bp, Homo sapiens
  Genbank Accession No. H40534
  unsure (1)..(443): n = a or c or g or t
aantannnaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccagggacagggtctttgagctttcccactntaagaaggaacagcaacaaaaggccgtctaggaaaaacagaacctgcctctgcttctgctcagggtntccccgctggggtttccattgtcctttctccattgctccctcctgtggacaggacatcttgctcatgtaccagccctnattcaccccatcccctaataggggggtnctcgngggct

SEQ ID NO: 1924 - DNA, 395 bp, Homo sapiens
  Genbank Accession No. H41084
  unsure (1)..(395): n = a or c or g or t
ttatgtttaatcagcattgtggaaaatgcaacaatatctgttcatggnacttgagaaccccagagtgggnaacagcaggtgnggnatgtggggagaagaaaggaggagggtctggagagcggccataggggaggcaagtgtgaggagccaggagtgggggccctgggctgccctagacagggacatgcgggcaccccgtgggttctttggcggctcacaggacaatggcagtggaggtctgctccctagagggcgaagggggcactgaattctcccccagtagcctcttctctgatccttcctcattcaggggctgggagctctggccacacaagtttcgaagacctactnccaaggaaaccaaggacacaatgaccttaaagacacagacagcc

SEQ ID NO: 1925 - DNA, 404 bp, Homo sapiens
  Genbank Accession No. H41280
  unsure (1)..(404): n = a or c or g or t
gaggttaanaaatacccatttgtgggtggntttattgttaaaatgattaaacatgctaaaatcacatggagtggctattccacttttgccctgactccatagtggggcaaatgggaactacaggagtcacttggtttgtgtggcctctggggatggttagacttggagggttagcggtgagcaggttagcaaagccccaagcatccttcatgtagtacacttttcccaggcagtaaaaaaattcagagatttcccccttcttcacttttctttcctccctatatgtgccctacttctcattctcctatggccctggggacctcttatgcttctgcccgttatggggcttagnctaggatgatgagggaggcttttccttgacaccagcattccagtctcccctt

SEQ ID NO: 1926 - DNA, 414 bp, Homo sapiens
  Genbank Accession No. H41529
  unsure (1)..(414): n = a or c or g or t
ccagggggagatgagntcgnttnacgtgcttcagcaccgngcttcagggagctgtcgtagcgcacgctcaggttctggatctggatcttcccttggtctggccagttctttgggatcagcgatggtgctgggggccgggctgggctcagcaccaggcatgggccacagctagtatccgaaagtgccaccccatccccaggctcccttgtggcccccaacccagacacactcctccttggactcttccccacccctctccctgagcctctcacccaggagcccctcgtagctctctgcctcggttttcaggagcccatggatgcgcttcacagcccccagctgggagctccatgtctgccagggttcctcaccatccagttgaggtagttgggagacctgtgggggagcaagcca

SEQ ID NO: 1927 - DNA, 360 bp, Homo sapiens
  Genbank Accession No. H42053
  unsure (1)..(360): n = a or c or g or t
ttccacttctttatttcagtttatgtgaatattagagctacgcnncaggtgagatcagantaaggcccgttaacaatgaaactgaagcagaggacttagtcctgatttctgtctcttgctttctcttttctctttttttaatatgcaaacaaaaaaatgcaaaaatgaaaatgacaacacaacatcagaaagacatttttttaacttcattcgctacaacagtcacgaactgggttgaactctacctgccatccaactttaaggaaacggaggacccgggcactgtggaaaaaggaaacaaaacccaaacaaaacantggatacaaggcaactgcggttttaatggtaaaaatggggggt

SEQ ID NO: 1928 - DNA, 368 bp, Homo sapiens
  Genbank Accession No. H42321
  unsure (1)..(368): n = a or c or g or t
taccgggncctttctanttttatttgggggcacacccgaacgcagggccctgacacctagcaagnaaggtgttggggcctcttggtggtgaagacgtggcttgtgctgacggcgcaggacccggtggggtcagcggaacttgatcttggagtcgtggaactgcttgacagaccggccggcggcacttgctggcccgcgatctcctccaccttcatgatctgaatggagtgggctcgggcgcggtgccgggcacccatgtctcggtagcactgggtgacancgcctncggtggtcangtcccggtattcccggtacangttgtgggtgccgctccgggagtcatagcgcancagatcccgaagttcttc

SEQ ID NO: 1929 - DNA, 380 bp, Homo sapiens
  Genbank Accession No. H43286
  unsure (1)..(380): n = a or c or g or t
cctatttgcacacgtccatgtttatccatgtacttnccctgtgtaccctccatgtaccttgtgtacttnctncccttaaatcatggtattcttctgacagagccatatgtaccctaccctgcacattgttatgcacttttccccaattcatgtttggtggggccatccacaccctctccttgtcacagaatctccatttctnctcagattccccccatctccattgcattcatgtactaccctcagtctacactcacaatcatcttctcccaagactgctcccttttgttttgtgtttttttgaggggggaattaagggaaaaataagtggggggcaggtttgggaggagctggtttccagtgggatagttggatgagga

SEQ ID NO: 1930 - DNA, 301 bp, Homo sapiens
  Genbank Accession No. H43646
  unsure (1)..(301): n = a or c or g or t
aagccnttgcatcatttttattttcaataaaagtgaattgtcttttacaaaaccatggcgtcctggnaaagttgcatcactggggcggcttctggccaaggaagaggctcttggtggagaggactntgaagccntcggcaggtntgcccncggttgtgctgtcggcgctggctgccttactgacttcaccctgcttcttcttggatttccgggcccctttcttgcctcctgcttttttagatacaggcttcttctggggatggagacttggcctttttggctggggggtgggtgtgatgat

SEQ ID NO: 1931 - DNA, 365 bp, Homo sapiens
  Genbank Accession No. H46001
  unsure (1)..(365): n = a or c or g or t
acgagtgaatanntgccacagctccaggacccaggagcgggctatatactatcctcgacattcagggcccagccggcacctgaaactgccctggggatgggcctctcctggccaggccggggcaaacgcctcagcctcccctccccgggtccacatcgggggctggagagggagtggcctctctccactccaggtgctgccttaaagaaaatgggggaccatgcccacctggcgggcctntggaggggtctgcctgtctggccgtctggctctcgagctcccccaacttctttagtattagtaagtcaggaagaaaaggggcaaagcaggaaaatgcctcccagagccccttccccggagctgga

SEQ ID NO: 1932 - DNA, 397 bp, Homo sapiens
  Genbank Accession No. H46486
  unsure (1)..(397): n = a or c or g or t
gcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctgggacacccttggtggggtggggcctgtgggtgatggttttgcatccttcctcctttgtcccaataaagtatggggagttgaaaaaaaaaaaaaaaaaaaaaaaaaaaaaaaaaaaaaaaaaaaaaaaangcgcggccgnaagcttntttccctttagtnaggggttaatttttagcttgggcactgggccntcttttttanaacgtcgt

SEQ ID NO: 1933 - DNA, 450 bp, Homo sapiens
  Genbank Accession No. H46990
  unsure (1)..(450): n = a or c or g or t
taatcatgtgatgatttatttatattctgggaaaatatttattttcaaatactcatatgcaaagaaaggaatcagtttgagaaatcctgacctcaaacaattcgaaatcttgtttgaaagcggggggttcagggtgtcctccacacactcatgagcggggaatgacacagagtttgtaacgtggtgggatacagccaaacccaatatgtatagggctgaggtcgatatcctttgggtcaacgagaggcttcaaattaaaatgctgcaaaatggcacacaacaaaagaaacaactccatgcgagccagggccttctccagcacacactcgttttccngtgggaaaatgggcttgaaatagtcactgtacttgaactttccnttttcattncaggaagtgttccggcttaaacttttctgggtccaggnaattcttgggtgtcataccaaac

SEQ ID NO: 1934 - DNA, 407 bp, Homo sapiens
  Genbank Accession No. H47357
  unsure (1)..(407): n = a or c or g or t
tagagacggggtgtcaccatgttggccaggctggnctcaaactcctgacctcaggtgatccgcatgcctcagcttcccaaagcattgtcttttattttntattgttattttntcaacatctaagtatttattaaggtgagtttttacaaacaagcatctatcccagtgtgcggggtgaggatgggagaggagagtggggcagcaggaagatgaggattctcatcttttgataataaagctccagggttcancccattgtggatttcatagtcccccagagacacatgggccttaaaaattgtgtaccacttcttcaggacaatcttgttccaacggggtgccagtttagggctgcaatcagcttcttaagggtccccgatgggnatcanccctgttggcatttaacg

SEQ ID NO: 1935 - DNA, 434 bp, Homo sapiens
  Genbank Accession No. H47391
  unsure (1)..(434): n = a or c or g or t
gnttgccactggaaaaccatgaaatggggataattagttaactccaacaatgtgagttgttttatgtgtatatcagatgacaatatttnctgaaaaaatacccataattcactctctataaataaagctgtaattcttggctataagacagcagaccttggtgtgagtatagtcccagaattaatcatcctttgtgcatacaactctttagcaaagcttatcaatttaagcagtctactttgggctcagattctaccagcttacagctcaggatcaggtatctgatgctttatttaattcctnctcaggtatatgctaatgggnggacactttgggaattcattctacacccttggaaaggataattccattttttaaaaaggtaacagctggctttcatactttaaataaaggntggggtttctatttggact

SEQ ID NO: 1936 - DNA, 319 bp, Homo sapiens
  Genbank Accession No. H47838
  unsure (1)..(319): n = a or c or g or t
tctanagtnnccnctttttattacataatnccttaccataaacagctgttgtaaatncgcaaaatgcggcatttgttgacagtacctagagccactcattcattcgtncaacagtgtttattgagcagctgagctgggaatgagaggctatgtttgncgtttttgacacccctcccctttctgggccatcgcctaattaccgtggagcaaacggaatgcatgggttgtatttctaaagggcacaagcagaaatttattgaaaatttgggaggcaggaaatctttaatgtacttctgaccacccttccttttgttgagta

SEQ ID NO: 1937 - DNA, 415 bp, Homo sapiens
  Genbank Accession No. H48459
  unsure (1)..(415): n = a or c or g or t
ntgantggaaggagtaaaactctttattcatagaacacatgactgttgatgtaatttacaaaaacaccatgagaactcacagtttagcaaggctgaaggatacaagttcaacatcaattgtatttctatttactagcaacaagtggttagaatttgaaattttaaaataccatttagcatcaaaactatgaaatgctgacatggtagacctgtacactgaaaactacaaaagattattaagagaaatagaagacaaaacattaatacctagggnagacagaccttgtttatagggccagaaggacttcaatattattaaggntggtcaattctcccaacagttttattataaattccaatggcaattctcaattcagggngccccacgggggttttttggtggtggtggttgtag

SEQ ID NO: 1938 - DNA, 394 bp, Homo sapiens
  Genbank Accession No. H49415
  unsure (1)..(394): n = a or c or g or t
tacacagttttgtttgctattttcaggggaaacttaggcattcaactataagctgataaaataccatacctaaaaaagtataaaagtataaatatccccttagaataaattttagtgaattgtcttaatatctttaaatttaaaaaaaaaacacaacacangcctatctattgtatcaaggncaaaaatcaaacaatgctaaggggccagcagctccccagagngtacaccctgagggcccacagtggctgccttcctccagagctctgctggggaggacaggtcatcccatgggctaagtctgccctctnggaaaggcttttataaattgtctaaggccaaacatttaacaggcatacaaggggaccttacaaagagggaggtgggtaagtcc

SEQ ID NO: 1939 - DNA, 443 bp, Homo sapiens
  Genbank Accession No. H49417
  unsure (1)..(443): n = a or c or g or t
tttatttaacacactaaggtaaatacatatcacatataaaaattgtcctataatacagccagtgggggaacataaaaataaatgcataactttttaaaaggttcanccnaatgtggctctaaaattaccttgtgtatccaagagtctacatggtatgttttggaaaatgccaggttatggtagctataaactgtccaggnacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggagggagtctactttaagacttcaccagggtnccagcctgtcccctgnctcccccgaacattgccgggttccgggtcccnggggttggcagtaa

SEQ ID NO: 1940 - DNA, 318 bp, Homo sapiens
  Genbank Accession No. H49637
  unsure (1)..(318): n = a or c or g or t
tttattatctggccatagtatttgggnacattatcaggtaccgatttaacaccatgtaacctctcttgacacagagcaacccaaaaagaaaactttaaaatgtgcgacagaattaaatatcaagctttgtcatctaaantgtataaatataaantatcagtcatttctggaaacatcttangaaaatccggcaaccacatgtccatgagtaggtgtctgatgttgacggtgcttacattcagaacatatcacctcagaatccaacacatttntttttatgtctttnaccaacacatgtttggcatatactgaacagcc

SEQ ID NO: 1941 - DNA, 452 bp, Homo sapiens
  Genbank Accession No. H51340
  unsure (1)..(452): n = a or c or g or t
gggcttctcttggccatggtccccttccttctggaactgtgatgtagtcacatcctacagcctttagtgctggttcactagtgtcagataatccttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatanagtgtncttttgaagtaaggccagctgttgaacggttaaactgtggcatttgcgcantttgaatgtgttcatgtnatggtnaatgtatgnaaatgtttaaataaaatgc

SEQ ID NO: 1942 - DNA, 266 bp, Homo sapiens
  Genbank Accession No. H52251
  unsure (1)..(266): n = a or c or g or t
tttttaaaacacaggctattcatgtcacataaatatcttcaactgtaggttagctgcttatggtcagcagaattatcaagtgtgactattaagaataacttagatactgtcacttataggaaagtctaaagctctaagactcaccatattaaaatttcagatacttgaatactgttgctattttgctaatttcaaaatatttcttcatntcctgcaatgtagtntataagtngttagtaatcaatattcaaataaangcaacatat

SEQ ID NO: 1943 - DNA, 449 bp, Homo sapiens
  Genbank Accession No. H52673
  unsure (1)..(449): n = a or c or g or t
annagtggatattncacagtttatttccaaacactcagagganagggggtggcctatgggtccatctgcctcccctccctgcatttggctgaatcaagaacttctcccccctgacccccaagaccctaggctgtgccaatagagaaggcactgtcaccccccaccctgaggagacctagacaggtgaggagcatggagggtgggggaacagagttcaagtattcacagttcccccatctacaccccgggattacactgtgccagagccatgagggaggatcccacctctgggattcctagtgggtgttgatagtccttctcccacttaggaaccctccagatgaactccctactccttttccctggaaataacaaaccaaggtcctaaggccctgtagtttggggcaagggagggagtntaggnagggccattnacccaagggcccntt

SEQ ID NO: 1944 - DNA, 445 bp, Homo sapiens
  Genbank Accession No. H52937
  unsure (1)..(445): n = a or c or g or t
nntttagtttaaaatggaatgacttttattctttgtcaaatattaacatacctggnacagtgaaacantggacaagttgtcccgtttctccatttgtctgttcttgcatccatagaagggagttttggcaccactacaggtcgtacttccagctgtgtcttggattgggcagtaggtgactttatagcaggtggcggcacaggaggtggtggaagatcatctgtgtaggtttctctgcgcagatgtcctggctggtgtttcagtttcttggctggtctggttttctgcattacggcggcactcatgttgctgtctgtagacacgggacttgtgggcctagggcactgagacgcatgaaaatgtcgacggccagcagcatcccgcatttgccgtcgtgctactttcagaccagcatantctgccgttgctgcantgcccggggaan

SEQ ID NO: 1945 - DNA, 414 bp, Homo sapiens
  Genbank Accession No. H53657
  unsure (1)..(414): n = a or c or g or t
ttcggcacagggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgcttttaagagaatttnacaggtattgatgaaagaacaaggactgttttattnaaaagctttattcaacttgga

SEQ ID NO: 1946 - DNA, 345 bp, Homo sapiens
  Genbank Accession No. H53829
  unsure (1)..(345): n = a or c or g or t
aataatctccaagataaattgaatccttactatatgccagacacagaactactctattaggtactttgctaagtaccttggataacattacttaatttttacaacagcccctatgagatagatattactactgccatcttatgatgagaaaactgaggtccagagtggttaagttctcataacttgtctttgaagctaaaagaggcaggatacaaagccagggctctcccaactccagaggctgtggggttgcccagcatactctactgcctccattgcactgggtatttaggtgcttttatatagggtgcaaaccaagggctatcagngcatgggggggaaggg

SEQ ID NO: 1947 - DNA, 437 bp, Homo sapiens
  Genbank Accession No. H54285
  unsure (1)..(437): n = a or c or g or t
gtggttttttttaatgcaaaatataaaatgctggcttgggaagaagattctcttccaaatcttgaacacaaaatcttcaaatggttagtgatacaaatatggcaactgagatacatcctccttatagcaaatgctaatgtcttgtatacatcattgcccttaaccttctcaccaccccagtgagtataaatttttaactccatttatcaatgggctcagagaggtcaatcaataacacacagggaggaaaggggacacgattggaaccaaagccagagctcttaacctccatgctgtagaacgggaaggacaagctaaaaagaaaccatccacggttgacagtttctggccatgccgagggttagccacttgggaattgtgntggaaaagtataggatagtnggcgttaccgacactgggcntttaccaaaggggaa

SEQ ID NO: 1948 - DNA, 154 bp, Homo sapiens
  Genbank Accession No. H55437
gtctgatctcagagctgaagctggctgtgcctggggccacatcgcagccaaagcctggggctccctgcagggccctccagttctctgcctgcacggctggctggacaatgccagctccttcgacagactcatccctcttctcccgcaagacttt

SEQ ID NO: 1949 - DNA, 467 bp, Homo sapiens
  Genbank Accession No. H55759
  unsure (1)..(467): n = a or c or g or t
atttttccatttgcagtttgctgaagctgtggatgcagaacccatgaatatggagggccaactgtattttgtaggcagttgaaaacattgccctggagctcaggagatggctctggctggagaattcatgccaagggagcctggcattttcgtccgtccacgctcctgaggtcctcctcaaactccactcccacatcaaactgcacagtgtagtttcggaaggtgctgagcgtcctcaccgtcatgtggttgccctgggtgttcgatctccttgtccggcttcagcagagcgcgatcttccgcacagccaagctgatgtctgtgggggctgcttagggcttgcaggtagtcctccatgttcttctgcgagacaaagcggtagtagccagtgaggttggggaggcattttttggatgaaggttcaggagaatgcaggagacagggtnaggaaggagggtttttttttn

SEQ ID NO: 1950 - DNA, 400 bp, Homo sapiens
  Genbank Accession No. H56345
  unsure (1)..(400): n = a or c or g or t
ncccttgactttatttatcttcataagncacaaaatgtgagtgcagagataaatgtctgtgtgcatgtgccctgagcaacagggtggcataactcggcacactcataatgacacagccgttcacccagccacagntagtgacagggcacacatggcgacacccacatgtacggngntaantctcccccaccatgacatgggtagacagaaaacacgccgcagtntactctagtntgtttacacaaacngggagacaggcccgtgcantgcatgttcaccaacacccacantcagngtgacatctgctggagggtgttcaggacacaggccacccaccgtggacatggccgagntttcacatttnttcacatggacacgggttggtttgccactttcantg

SEQ ID NO: 1951 - DNA, 463 bp, Homo sapiens
  Genbank Accession No. H56584
  unsure (1)..(463): n = a or c or g or t
gcagttccaggcttttctccagcaggaggagacttggctcagactgtccagcaagtgggtggcccagtggaaaccagggaattcctgagggcctggcctggcctcctctcttcccaccccacctctagccactggacatactaccttttgtgcaactaagctaaacagaggatttccaagggtgataactggggactggtggccttgagatgaggaattttagaagatatatgaaggcctaaaagatcactatctttcattcagggaaatcagaaactacttctaggcagggggagggaggcaggcaggggaaagtaggaaagggcctggggcagagctgtaatcctcagaacttgtcagccttcagttcccccttgtctgaactgaggcactgcccctcagagtcctcccagagccaagacaaaaccaagacagcaggaccagggnttgccanttttttttt

SEQ ID NO: 1952 - DNA, 248 bp, Homo sapiens
  Genbank Accession No. H56965
  unsure (1)..(248): n = a or c or g or t
tttatatgattgnaaactnatggtccccagattgtatggaaatgcctagtggcattaaggatgcggtaggatgtccacttttagtagcaaccgatgttcattcactactccatgttaggtgctttacttggattatctcacttaaaaaccacaacattttatctctgttttacaaaggaagaaactagaggcttaaaagatttcagttatttgacaaagatcacaagctagtgggtgtgacatgggga

SEQ ID NO: 1953 - DNA, 415 bp, Homo sapiens
  Genbank Accession No. H57056
  unsure (1)..(415): n = a or c or g or t
ntggatgtacaaaaagaagatattttattgaggaagttgcaatgtttttacatacatgcacaatgcttacacaaattcagcttcgtgataatgcactttcatggagtcaaatttgcaaaaatgcataaaatganttagaactttctaaacatctttatacaatttataccttcagtattaaaaatggactgaggaggccgggcacagtggctcacacctgtaatccctgactttgagaggctgaagtggggcggatcacttgaggttaggagttggagacctgcctgggccaacatagtgaaaccctgtctgtaggtaaaantacaaaatttaacacttgagcccggggggcggnagggttgggagtgagctgaggattntacccactggcactccagcccggggttgacaaagt

SEQ ID NO: 1954 - DNA, 391 bp, Homo sapiens
  Genbank Accession No. H57060
  unsure (1)..(391): n = a or c or g or t
ncagaaacattttattgacaacagttcccaacagagtctttggggtctttaagtggcaggtgcagcgtccacaggcagagtgagggctcctgaggaacctcaccccaaattccctaaccggccgaggacgcanccccaggcccctctcaggtgggcatggcagtcccggcagcaccccctctgagcagcctgctgtggggaagaagccgggccggaagcctcagtcgtggtgccagcccagctcatgctccccgccccgaggcccccagcctntgggaagcccctgcctntaagggacagctcgtgaagacacaggaacagtggttgggggtgagggtctagggaattggggcagagggtngcttnagcacanacctgacttccctgggag

SEQ ID NO: 1955 - DNA, 459 bp, Homo sapiens
  Genbank Accession No. H57166
  unsure (1)..(459): n = a or c or g or t
gcggagtctctccatgttgcccaggctggtcttgaactcctggcctccagcaatcctcctgccttggcctcccaaagtactggggttataggcatgggccactgtgccagatattttttgaaatccatattttcttgacatgaggtagctttttagcagcatttcgggtgctgttccccaaacatagtgttgtttggcatgataccagattggaggatatcctagtcatctaggagaattatattttgttgcagttgaaggtgctgttctagatatactaatgcagtgggagagaaataaagcaatttgagaagaggcagcacttttataggaaagaaaataggatacccaatcccattgctgatcaatttcctcctacttaagcaacattaggctgattttaattttccaataagccattaattaccnaatttaggggaccaattccaatttactggn

SEQ ID NO: 1956 - DNA, 374 bp, Homo sapiens
  Genbank Accession No. H57709
  unsure (1)..(374): n = a or c or g or t
gcaattttataactttatttganctgacgatcagcgattagttctcatccacattgactgtctgtaganctgtaaaggaagtaacagtcaatttccatacccacatcacatttcatatttcaactctaaaaaccttttgtagacgggtctgggcattctattttccacaacctttttacatcccagatatgggancagttttgcattctttaggcatcttcccacaccaacaatttaaaaagggtacaatgacgtgtgtcacccctaggcttaacagatgaattcacattttaagngggtaagggacatttttctaatgaatttaaatgggctttatggggatgggnggaacttacttttggaaaggggggaac

SEQ ID NO: 1957 - DNA, 151 bp, Homo sapiens
  Genbank Accession No. H57816
  unsure (1)..(151): n = a or c or g or t
aaaaaggctagaattaagcttatcataacanaaaaaganaatagatattttacatggaatgcaagaggggatatagttactaaccatacagaaattttaaaatgtaattttagagcaataaatttgaacttttttataaagacagatttct

SEQ ID NO: 1958 - DNA, 384 bp, Homo sapiens
  Genbank Accession No. H57850
  unsure (1)..(384): n = a or c or g or t
atcattttaaaaagggctttaatactgtttaagtagttcaaataggcttcctcactattaatttgcttcagtaaactcttcagcttaactcattatcttaaatttcagaattaatgaggttttactgtaaaagtagaaaagcaaacacttcaaatgataagactccagtatcacccatactaaaancttaggcaataaaactgcagtttgaaaagctactgtacaatgcagcaaggactaggtgtcaatactgctggaagcgtagccagggtaaaggancaggaaatctgcacagtnttatccctgtgggttcttagnctcattcggaantacaggaactgcaatctcacaatggnaacaaacatactggcttnttaggggggg

SEQ ID NO: 1959 - DNA, 338 bp, Homo sapiens
  Genbank Accession No. H58673
aatttatatactgttttattgatacacttccaaattccctataattagtctgcatttgaattgaaatttcaaggtataactataatttacatatttaaggagtcattgggtatttaagtcataatttcagtaactgtttaatttttctagggtttgtaacttgaaatattatacccagcttctgattttgtggtctgattgcaccatacacgaggtatttaagtgtaggaaagaaatgagggaaatggggtgagtgtctttctgggtggacagtttagttttcaaccctagaaagatgaaaccccacccagggccacattgttcagcagtgctgtgac

SEQ ID NO: 1960 - DNA, 409 bp, Homo sapiens
  Genbank Accession No. H58692
  unsure (1)..(409): n = a or c or g or t
ntctcttcagaagctttattctccctgggaggggcacacctcacccagccaagggngcnttctgactggacagagggcgtccaagatgcagacatggtgtgcaggcaggagggcttccactagccccccaggtgggaggtgctgtgcccangggctcaagagggagggggccccagccacgagggaggggcagggactttcttctcacaaagacctttcttcagtattcgaaggtcactgtcttgacccgcaggtactcgttcagagccgcctctcctagatctttgccaaatccagactgtttgaatcctccgaaggagncggccacgtcggtcttgttgtacgtnttgacaaacacagtgcctgcctgggagcttgtcactgacatacagggccttgttgaagtccc

SEQ ID NO: 1961 - DNA, 440 bp, Homo sapiens
  Genbank Accession No. H58873
  unsure (1)..(440): n = a or c or g or t
actataacttagtgtctgtatttaatattgacaaccaaaaatatatatanttttnttgcatctatacacaacagggcaggagtctccatgtnttcttgagcagtgagtttgcaggctcccacaggccctcttctcatggtaatagtgtggccctagtgcaaaggagactagaacccggcagcccagactggcccttcccctctcctccctgcactccagtgcttcccaactggtctcaggtaaagaaagnttantttgagtggttgggtaggaagagatgggaaggggcaaatcctaatgggagcctgacccctagagtggggagttccagggccagcagaacgggtgggccatagccctncctggggntagaagctttgtagttcatagttcgattagtntgtccntagggcatnaggtnccagccctacagattagct

SEQ ID NO: 1962 - DNA, 326 bp, Homo sapiens
  Genbank Accession No. H59136
  unsure (1)..(326): n = a or c or g or t
ntttcagaaaactaccattttattacttttagcattagatacgtttacaataaagaattatgttaatagagcctaggagttccaattgctagttgagaatcacctcaagaaaaatagaaaatttgtagaaataattattaaattttaaaaatctaagccttttagacttttcaaaataaaaatttaagtatgctgccttcacagtgaatttaatgtgataagattttcattcaaatgacattatttctatttaatgttttaatacagttacggcatgaaatcaaattccaacttcttaaaaaatgtgggagtttttnggggatcat

SEQ ID NO: 1963 - DNA, 414 bp, Homo sapiens
  Genbank Accession No. H59141
  unsure (1)..(414): n = a or c or g or t
aatanaggaataataaattgatttaataatttgaaagaactgtaaggtttaggttttgttcttatttttagtgcgactgagattggagtctgtttgtagacatatctgaaaaaagtgaagggggagatggaagatggtaaatgccaaggaaaagatggaaggataaatcagtgtaataaaaaggagcacttctttttcgccaacagaagtaaaggtaaaggttaagtgtctgagttaacgaatggattgttgacctctggggagggtgctcccatcagctcagctttgtgacgacctaaggaatatcccttccacacctttcctgatccaatcgttctgggctgcataaaaccacctaaatcaatcaactgttacacttcccttagtgctaggggcatattcctnataactccc

SEQ ID NO: 1964 - DNA, 459 bp, Homo sapiens
  Genbank Accession No. H59617
  unsure (1)..(459): n = a or c or g or t
tgnnttcattntcaacattaaatgactatttatttttcaggtttaaaagatttcaaaatacatatgtacaagataaataaactacacaaaaattatgtcatcaaatatatttaaaaaaaaattcaaggtaggcaacttagatcaccttggcaaagaacacattaactangatgaaccaggacaagtcccctaaacatcaggatgaaatttcttttctatgcctactagctgactggccttccttttctgngttgagttgtgtactctggagtcaccagcctctggtagattatcaagcatctcttcctcatcagccttttgtttctgtcttgcatgcttctctgtccactgtctgggcattcttgaggaaggctggcttattatatttaaattctgagggtatgtcagcctgagcggggtcatcagggttgggttccgacatgagcagccgattagggg

SEQ ID NO: 1965 - DNA, 345 bp, Homo sapiens
  Genbank Accession No. H60317
  unsure (1)..(345): n = a or c or g or t
ggtgtacaaatagacaagtagtttaataaagcagaacaaagagtctagaaacagactcacagatatatggtcaattttcaacaaaggtgcaaactggacatcatcaaaattaacctctctctgctctttgaaagacgctgttggctgggcacagtggctcacgactataatgccagcactttgggagactgagatgggtagattgcttgtgcccagcagctcgagaccagcctgggcaacatggcataaccccatctctacaaaaanttaggctgggcatggtggcacacgcctgtgggtcctggggaggctgagggtggggagggatagcctgaaccccgggga

SEQ ID NO: 1966 - DNA, 284 bp, Homo sapiens
  Genbank Accession No. H60595
aagacagagtggactgttacaaatgattttgcaaaatacaaaaatagatatacttccactgaatgctttaatcatttttccgggcactctcatcttttggttcttcctcatctgagtacacagtgggctcctccccctccttcagcagtttgcccacgtgatgatacttgaaagtgaactgagactcccagtcactcagagtctcctgctgggcgcagtgaggtcagaaaggtcatcgtactcatccttcagtgcttccttatccggggaaaatgtgggcaagg

SEQ ID NO: 1967 - DNA, 409 bp, Homo sapiens
  Genbank Accession No. H61002
  unsure (1)..(409): n = a or c or g or t
ggcacgagcaaccaacatcttgtaacttgctttccccaccctgtttctgggggcagagcaanttgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggacttttcgggatttaagcactcgtctctctngggaggcccagaccccactccatttattagggcacatcttcctttcatttcctaggtcaattgcccntttgtttttacagttcctggcctgctncctttgancacagnttgggtttacaa

SEQ ID NO: 1968 - DNA, 317 bp, Homo sapiens
  Genbank Accession No. H61295
gaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaa

SEQ ID NO: 1969 - DNA, 401 bp, Homo sapiens
  Genbank Accession No. H62212
  unsure (1)..(401): n = a or c or g or t
nnnttcagttgagagaagcaagactttaatgaagaatgctacaagtatggacaataattagttctcaccttttaaaaaaagattacagaaaacactttactgaaattttttgctaaaaagacagtctttaagggtgtccgggagagacagcaagcacaacacagtacaaaaggagaagggaatgttgaattccagtgcaagacacgaacacagcacaattagggaatcaggaggaagcaaccatttcacaaggaatgaaattagggcatttatattcaatcggattttttttaagctttaaaagtccagccataagggaaggggaattgggggaaaagaggcngggggacagggggcaggggatccggggnactagtcttnttctncaatcacccttttac

SEQ ID NO: 1970 - DNA, 323 bp, Homo sapiens
  Genbank Accession No. H62474
  unsure (1)..(323): n = a or c or g or t
caaatacagctgaccagaaggcctaaaaacagcccagactctnccaaccctcatgcatctgtagatagaaggagagctgtggncttgctcacacacaggggagcccttctnagaaganctgcctgncccttggaaggtncagagtcttgggcccagcagcagagaggagcccaacctgcgtgggacaaccccttgagggcagcccttgggtcacagctgctctggggtggggcagcagggtttaaggtttcataggttcacatgtncccaccacacaagtcaaatcaagggcatgaaaataaaaggggnaaaagggggnaggg

SEQ ID NO: 1971 - DNA, 372 bp, Homo sapiens
  Genbank Accession No. H62838
  unsure (1)..(372): n = a or c or g or t
ttttagaaaatttattatgaattccgagaagtctgctcatcatatacctcccccagccccaaataaaacaaacaacatgtttgtacataaagcctgggtttacttggnacaaaatttgagtctttgaaaaaaatagttaatggnaaatctcaataaaaattcattttgaaagtaaccngtactgttcaggaaataaggggngtcatgttacttgaggangtcaaacagttttattacaggaactatgtgtatatattttggggnttaaaacttgccnataggctgtttggaaagggntaggctcataatttattccnaatagggtattttnttaatcnaatgtttttggggttatcnaccataaccccntgg

SEQ ID NO: 1972 - DNA, 236 bp, Homo sapiens
  Genbank Accession No. H63251
aaatacttgtaaatttcatatttattgtaacaaaaattatgacatgtccatttgtgcattctgcttgagtataactctgggtatgtaaatggcctaatggggcactatacaaccatgctgattgtggcagcagtaaggaacacagttaaaagtgtctgtcaaagtgggaaggctgggacaggggaggaaaatgggttcagggcccttgggtgcaggttcttgtccagtggcctaag

SEQ ID NO: 1973 - DNA, 370 bp, Homo sapiens
  Genbank Accession No. H64493
  unsure (1)..(370): n = a or c or g or t
gggtgctttatttccatgctgggcgcccgggaagtatgtacacggggtacgtgccaagcatcctcgcgcgaccccgagagcccggggagcgggngcttgccggccgtcgcactcatttacccggagacagggagaggctcttctgcgtgaagcggttgtgcagagcctcatgcatcacggagcatgagaagatgttcccctgctgccacctgctcttgtccacggtgagcttgctgtagaggaagaaggagccgtcggagtncagcatggggaggcntgggtnttgtagttnttctccggctgcccgctgctttcccantccacgggcgatgtcgctgggggtagaagcctttgaacagggaagtcaggc

SEQ ID NO: 1974 - DNA, 385 bp, Homo sapiens
  Genbank Accession No. H65030
ttaatcctaattgtatttctctattcctgaagagttctgtaacatgatgtgttgattggttgtgttaatgttggtccctggaataagattctcatcatctccttcaatcaagcagtcccactgatcaaaatctttatgaagtcctaaatgcttttgtaagaatgctaatgaagctttgttgctaaggatcaatagctgcatttgaatctatgtctccctttaatttgaggcatgtgtccaattattttgccagttgcaaaaggtgaagtcaggcaaaattctgggtgggactggaacccctggattggtaatcatctttctttctttatcgggtgaggtaggccatttttttcatttttatggatataggccggggtattggggg

SEQ ID NO: 1975 - DNA, 314 bp, Homo sapiens
  Genbank Accession No. H65042
  unsure (1)..(314): n = a or c or g or t
tatttattgaacaccggctgcctagcacaagctgtaccngtgaatacaaagaaagccgaatgatacagcccttacctttgaggaacatgcatttgcaatccctggggcacagaggccaagagcaggccgtccctaacaatgttcttgcctcaagcccagtagagatggaagcctcaggacagctccttctttaacgcagaggggttggtaactctagttccagggctcccaatactgcagtgaaaaggaattttgtcctatccggccaaggcaaaaaaaaaaaggaacagtcaaaagattgacgggacaacatg

SEQ ID NO: 1976 - DNA, 459 bp, Homo sapiens
  Genbank Accession No. H65650
  unsure (1)..(459): n = a or c or g or t
ttgataatcaatagaacatttactgaccgtatactgagcacctattctatgcctaccagtgcttttttaaaacctgggtgagggctggtatatcgtctttgaaaaacaatgactataaaagctacaggaaaggtatttctataaatcataacatgattcagtgtaagggagtatcaggcacttggcccacgccaggtgctctgttaaagtagcagctttattctaaaaggctaatgtggatctttaaaaggtttccgtaactgggagaacccaggttgaacaggatttttctcaccagcatggctacaccagctttgcagtggcagantgagctgcagaggtttcctctctgctttacaatcccttatttgaagtacacgcgtcgcaatttcagggtggccctcttgggtcctagcttgcaactcggcctcccagcttgtcacaggctgggtccggggt

SEQ ID NO: 1977 - DNA, 413 bp, Homo sapiens
  Genbank Accession No. H66367
  unsure (1)..(413): n = a or c or g or t
tgtgttagacatactaataggtgcacagtgaaatacttattgttgattgtttaaaaataaagttttagaaaaccttttcaaaagtcagagtttaggccagggcacaggctgacacctataatcccagcactttgggaggccagggcgggcagatcacttgggtcaagagttcaaggccagcctggcaacatggcaaaaccccatctctactaaataaaatacaaaaattatccaggcatggtggtgcatgcctgtaatcccagctacttcgaggcttgaggcatgagaattgccttgaaccggggangcagaggttgcagtgagctgagattcttcccactngcaattcagncttgggagaccttaattcaaatctattttgggtcttatattcttcttatggtttgtngtta

SEQ ID NO: 1978 - DNA, 369 bp, Homo sapiens
  Genbank Accession No. H66840
  unsure (1)..(369): n = a or c or g or t
aaatcagaacatcaatatgattcctgagcctttaccttcattttaatgagaatgcagtcaacagtaaattatgacaagctatagtggttttatcttcaaatatttacatggacaccaaaaacacctttcaggactactccttaaagncactcgtccaaacacatccatccatctgaggccaagacacttttcatgggaatgcaatgaaactatgaaggtgaatgggaagagagatgcttcagtctctcaaagtgcagtcatgagtttatctcgntacatcatactttgcatccctcctaaggttccttctgggttctgggtcgtggggcataattcaaaatggggctggtccttcttccactgggcccg

SEQ ID NO: 1979 - DNA, 440 bp, Homo sapiens
  Genbank Accession No. H67094
  unsure (1)..(440): n = a or c or g or t
aatgctatcttaatctaaccttatcatctgagctgctaaatctttcaccccaaaaagttaccacatccatctacaatcatttgcagtggcccttcagctccttcccaaccatttctcagtgaatagactcaaatgttgggtgaaactcactgtaaacgaacatggggtatatctgtgacggaacttctgaaagccatttgtctaaataattctgtctttatacacacatggcacagggtgcatggcacagagagggacaggggaacgggggagggctgtcatgggctatgatccggggctgacagggaaatctataaggatgaggaagggtgaggaaaactgtcagggaaatccacattttccaggaaaggccggggcactaatggatggctggcccnttcggantttttgttaacagntcccncgttttacggagngtt

SEQ ID NO: 1980 - DNA, 419 bp, Homo sapiens
  Genbank Accession No. H67840
  unsure (1)..(419): n = a or c or g or t
gagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcattcagggncagcgaaccgtttttcctcccagctggaggtgaagggccntaggggacgggagcatggttcacgttcct

SEQ ID NO: 1981 - DNA, 321 bp, Homo sapiens
  Genbank Accession No. H67964
tataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattgggatgtaattgcatacaaagcttgcatctcaatccttgaaagtctagtattaaatgggaaaaaacttttcctaaaaaaaaaaa

SEQ ID NO: 1982 - DNA, 291 bp, Homo sapiens
  Genbank Accession No. H68097
  unsure (1)..(291): n = a or c or g or t
tgaagtttatttnctctggcagtatgttttagtttcttgtttttnattttgttgtgtgtgtatgtgttgtagattttatgatttgaggttaccatgaggcttgcaaataacataacatgttattttaaagtgacaacttgacactgattgcaaaaacaaacagggcgaagagaactaataaaaactgtacactttaacttcattcctcctgtttttnaaggtttttatgggtttctatttatatctccttgtactattttgaaaagggnattgcaggttatcatttgttca

SEQ ID NO: 1983 - DNA, 407 bp, Homo sapiens
  Genbank Accession No. H68239
  unsure (1)..(407): n = a or c or g or t
aattttaattttatttttttacaatgtaccatgaacatcttttccatgcacatgggtgaaaatcctctactaaaatatagagcgccgtagttgggtcaaaaggctgctggtaacgagactgacatctaaagcaaagtatcagcttaaggttaaagcattgggcctggcaaatacctaccagggaaagcagggccagcantattctcatcagagaantcagattgganggccaaagnnttaaaggtatgggttatcgtgtaagcccctctggcccctacctccacccctcactcccctgacaccccgttgtccccttggggcgnattggttcctgtacatctctttgccatccnatganaaccacccnttttctgtttttnccttagctcctcttgagcccttgncac

SEQ ID NO: 1984 - DNA, 282 bp, Homo sapiens
  Genbank Accession No. H68794
  unsure (1)..(282): n = a or c or g or t
tccatgcccatcagggtttattgtttctgtaacagcggccacgcctgggggntgngtgttgcagctggagatctctcagcaccttgggttgggggcggggctgggcgggacatgggatggaggcggtgctgtggcagacagggtggaccttggggcctgcaggaggagatgagttcggcggccacagtggcccccagcagcagcagcagcagcgngaggttcagcgggcgcgntcaccgcaccaggtggaaggtgagccagtacatgagcataggntgcgcg

SEQ ID NO: 1985 - DNA, 486 bp, Homo sapiens
  Genbank Accession No. H68953
  unsure (1)..(486): n = a or c or g or t
caatgtgcttgtctaggttcgctattgtgagaatcaagttgatatttacctaacctatatcctccacaaaagcagacagtctggctctgctcttctttcctccatccttagcccacagcacagaaactggcacattgcaggtgctttttgctatgtcagttcctcacctgcttaaagaggtcagggaggacagtcttcctgggcgactcctggcctcaggaactcagatgtgtgagcctcgcccataagaaacaaggtggaggaccctgtagggcaggaaaatcatgttaacagctttggcgtggggcactccccagggataggcacaggagctgtgcaggncaagtagaaaagagcactgggagaacggcccagtttcacagaagaggaggcagcaagtctgccacatttttgttattattgctggaaatttgtttcattcacttcgacagtttcaggaattaaatattagggnagatttttttt

SEQ ID NO: 1986 - DNA, 452 bp, Homo sapiens
  Genbank Accession No. H69138
  unsure (1)..(452): n = a or c or g or t
taggataacattatttatttatncccttttatcaaagaaggtaattgatacacaacaggtgacttggttttaggcccaaaagtagcagcagcaacattaataatggaaataattgaatagttagttatgtatgttaatgccagtcaccagcaggctatttcaaggtcagaagtaatgactccatacatattatttatnnctataactacatttaantcattaccgggnactgtttgtnttgtaggtgaaccttgaggtatgtgctgttaatataccaaattggggtgaaaaaataaggggattcctttcaaaaggttaagaggaaggtaaggtgtggtaaggncattattttgcttattaaatgttcgggtaaatggggcttntcttgtncggtaaanggggggaataaggcnaaaaanattggggccaaggcccnttaaggtaggggggtt

SEQ ID NO: 1987 - DNA, 485 bp, Homo sapiens
  Genbank Accession No. H69565
  unsure (1)..(485): n = a or c or g or t
tgggtatcttttttatttcaaaataagaggggttttaatatttctacacagcattagataatagcccaaacatattattgatccccaaacaagtattttccagatcaattaatagtcattatcaattaatattcatgtctacctgtctgagcaatggattagaaacattataagtttcattttatggaagagaaagcagactaaaagtctagggatatgatcatttggtttctggtttcagttctgacactaacaaggcaatatccttggggcaagttgtttaatctttgggggccttatttttctcaagtagaggaataacgaagctgggatctcatgctccattcccatctcttncctaccccccattatttcataaggttttcttggcccctatttatggccctaggnaaattctaggatcaggngaggtncccgncccattttcaggagtaggaggaggcccgggggctaggctggcgnaa

SEQ ID NO: 1988 - DNA, 408 bp, Homo sapiens
  Genbank Accession No. H70485
gaatttgctggctggcaggtttgctttgcttaatacattgactgcaacacgcttattgttgtgttggtagaataagacatacgagaatatatatagaaaggccatatggaggtttccatggaaagattctgatactccataactctgctgttcagaatttcagctgattgcctgtagttggtgcagcgaacggaacgctggtggcaggtgttgttgctgcagacacagtggtaggtgtagcaccgtgcatcatggggcactgcagggataaatgccggctgtggggagctgcaggttagtcagagcctgttggcagtgggaaaacagtggggattaaagaccggggtgggcaccattggggctttttccagtgctgatctctttgggtatcagttgcagtgtaccagg

SEQ ID NO: 1989 - DNA, 243 bp, Homo sapiens
  Genbank Accession No. H70554
  unsure (1)..(243): n = a or c or g or t
caaaatacatgtttttatattttaccatatgttcacatttacaagangtctttataactctatatggctgtaagttactatttcctttcattcaacctgaattcctcccttcagcatttctttgagagaaaaaataggaaaattagtgattggaggtccctataaaattttcttacatctcaagtgttcctgaaatcaggtgtttgggctttatgaaattctgagtaactttttttttaacaa

SEQ ID NO: 1990 - DNA, 314 bp, Homo sapiens
  Genbank Accession No. H70627
  unsure (1)..(314): n = a or c or g or t
atttagtgctttttattaacagtattactaaggcaactcatcgatgctgaagtcccatccagtatgctatttttcatgcctcaggtctaataaatcttaataaaaccagaatgactagatgctatggtctgaatgtgccccctcccacccaattgatacattgaacccatcactgatgtagtattaagaggtggggtctttgggcaggtgattaagtcatgagagantatccctcatgaaggggattaatgcccttataaaagaggctgcgggctgggtgcagtgactcatgcctctaatctcggcatttgggg

SEQ ID NO: 1991 - DNA, 182 bp, Homo sapiens
  Genbank Accession No. H70739
  unsure (1)..(182): n = a or c or g or t
aactttaatgtcgaaaatgcaaacttggggagagcagaaagatcacacacaaggctgtcacctcacacttggagggttgcacagcggccgagcagaggcgctcctcacttcccagacagggcggcggcggngcagaggtgctcctcacttgccacacagggcggcacttggcagagtcgctc

SEQ ID NO: 1992 - DNA, 280 bp, Homo sapiens
  Genbank Accession No. H71169
  unsure (1)..(280): n = a or c or g or t
ttgaaaaactgaacaaacagaagtgattttatctaatacagttccaaggtagaaaaagtggagcaggcagggcttgcacccctctccacccccccatgggggtngngtttagncggcacatacacaatcatagtaaattggcagaagaaaaacacantagattcctgggctagatggggagagataaggcantntgcatgggggattcagaggggagntntgagcccctctgctcctcccacaagagtttcccctttgggccgggcacggtgggcttcac

SEQ ID NO: 1993 - DNA, 381 bp, Homo sapiens
  Genbank Accession No. H71861
  unsure (1)..(381): n = a or c or g or t
aaagctttttattgattgaaatgaaagacattttctgaaatgctacaattaccatttcagggcttcagaaagactgagatactggcatttaacaagatacttagtggacaagagatcacaaaataaaacacaaaatgagacacggatgagttcatacgtaatggcttttatattaccttggatataattctttatatcactactgcatatttattacagtatttctaaacacaatttgaaaaaaaganacaaaganacaatcttggnacctcataatttagnccaaaagatatcagnacaaatagngccaccaaatatccatcttaaatactgtgtacatttaacagnaataatcntacatgacaaatggttcaaatttgg

SEQ ID NO: 1994 - DNA, 470 bp, Homo sapiens
  Genbank Accession No. H72650
  unsure (1)..(470): n = a or c or g or t
tgcagcattttccagtcacatatcagggttatactgnactgcaacaaagatcaacttttaaaaattagccttcttaaaatacaaaatgatttaagtattttaaagataatttatttgccttgctcttgccttctaacattagccatttcatggagaggctaaaacttatactccaaaaaatgtggaagcacattttaatgggagtaaaattaaaaaattttgagaaagggtaaaatcttatgaatatgcatcttcttagctttatcttccctttgataggtaggcacttatgctcttccatctgctcaaatagggctcagggaagccagtcatttccttagcgagatgattactcctttggcctttgaaacntttattggggcccaccatgtttgggntccagtgtgtggtagtgagtcctactcccaaatcagtgattcccaagtcttgggctttggggacccgttttt

SEQ ID NO: 1995 - DNA, 367 bp, Homo sapiens
  Genbank Accession No. H73484
  unsure (1)..(367): n = a or c or g or t
ttcaacaagtatttattgagtgtctattatgtgctagatactgagacacatcagagaacaaaaccaaaagccctgcccttgtcgggcttacagtctagcacttaccgccagttaacctgcaggctacctggggccccgggcaagtcaccgcacctctgtgcctcggtcctcagctgaccaatgggagantaagcagacctgggntcagacatgantcatgtgcttggtgtactgcagatgccaaactgcatccccacaacccaccacgtaggacagcagacagggctggaagttgntttttaatgataaagtacantgangggagggcagagaggctaagnctaggctgtctgggggtgctgtgggt

SEQ ID NO: 1996 - DNA, 391 bp, Homo sapiens
  Genbank Accession No. H73535
  unsure (1)..(391): n = a or c or g or t
gaggattgaaaaattatctttattatcttgagtgggagctggagctggaagtctccacttnctccctccaacaactcagctcccattgtacccatctggggacttagatgaagttacaggtcagttattggacagctcacaggcctcttgattcctaggagtcaataagaaggctttggagtccagggcaggaagtcagggacttgaattcctccacacacttttcgggaggatgtggtgagcgattgtagaggagaaagcgctggtaacccgggcctgtctcattcagcatgattccacctggggcatgagctgggaaaagagctcagtcttcatgtcaggggcggccttcagttctgagattctgtgctcccttcagtcaggtggtaga

SEQ ID NO: 1997 - DNA, 393 bp, Homo sapiens
  Genbank Accession No. H74317
  unsure (1)..(393): n = a or c or g or t
tttttttttttnggattcattcagcatttattgtagcaaagagtgggnagggacaggagctctaggactggccagtgggtntnctagaggccagctggggttggaagacaatggnctggacacttcactgggtggcaggctgtgtnccaagtnccacgaaatagctcaagaagttaaccagtnccgttccagccttcttgancaggggtntcagctgctcctttgacttttcaaagtaagacttggcctcggcctgaaagctctgggctcttgaccttctccatcaggtccttgccatagtcagtcacggtctggaagtactgagaaaccagggctctccacacatgggctcctttgcctgtctccgaacccaaagctccttcaaggctgcag

SEQ ID NO: 1998 - DNA, 451 bp, Homo sapiens
  Genbank Accession No. H75933
  unsure (1)..(451): n = a or c or g or t
agaagtacaactcatgtcgagacatgtatttattattatgctttgatatgcaatcccaggnattctgatctggagtaaaaagcaaactaaatgaagacaacttttagaaactgatgtttattttccatcaaccattttnccatgctgcttaagagcctatgcaagancagcttaagaccagtcagtggttgctcctacccattcagtgggcctgagcagtgggagctgcaggaccagtcttccgtgggcagggctgagcgctccaggtcttcagtaggggaattgctgaatagggcacagagggcacctgttacaccttcaggaccagtctggcaacctcagggctgaggtaggcagtggaacttcagggagcggggacangttccatttcaccctggaaattcctccttgggtcactggcnttttnaggcaggaagcctgttnttatttt

SEQ ID NO: 1999 - DNA, 348 bp, Homo sapiens
  Genbank Accession No. H77494
  unsure (1)..(348): n = a or c or g or t
aanttgtattttttgtagagatggggttttaccatgttgggtaggctggtctcaaactcgtgagctcaggtgatccacccgcctcagcctccaaaagtgctgggattacaggtgtgagccaccacacctggccaatgggcatnttctttggttgaattttaaaatattattttttatcatttaccattttctagggcattttaagacccaatttattctgccacaatcatgtcatcagaatagtcaaatgaaatgactttcatttgaattctcactattaagatttaaaattgtggaaaactaaagtggggattggagtagactgttagggattagntcctaggatgg

SEQ ID NO: 2000 - DNA, 317 bp, Homo sapiens
  Genbank Accession No. H77597
  unsure (1)..(317): n = a or c or g or t
tcaagtctaagtgtttaattattattcacatatttcacagaaaaaaaggaatgtagcaaatgagtcggagttgtagaaaaaaaaaatcctggnttttacgtgtcattctgttttcatctgacagcagggctgtcccgacatcaggcacagcagctgcacttctctgacgcccctttgcagatgcagccctgggcacacttgggcacagcccaggggnaaacaggagcagcagcctgggggaaaaagggagagagaaggtcacaggcagacttnaccagggganctccctttcccaacagcaggcctgggctcaagct

SEQ ID NO: 2001 - DNA, 271 bp, Homo sapiens
  Genbank Accession No. H78211
  unsure (1)..(271): n = a or c or g or t
tcatttttctaaagctttatttattttataaaatgcatagaataaattatactagtaacattttaaaaattaacatctttgtattcagcagtcctgggtcaggaggcaggnngngggtggnggggacgggatggctcactgggcagctaacccgtgtaggccacttcctcctcgtcactgccatcggggnccgcgtctgtcccaaagtagcggtcgccaaagttcccaagngcctgggatnatgcggaaaaggtcattgacccgnttgtcc

SEQ ID NO: 2002 - DNA, 373 bp, Homo sapiens
  Genbank Accession No. H78323
  unsure (1)..(373): n = a or c or g or t
nattgttaaaacattctctatatttaattncaattttataatagattacaggaagatgcttatgaaacaaatacatttgtttcagtacatgtctttaaatgatagacttataagtatgtaaacaactatataataaanggtttccaaacgctgcctgtaagaaatcaggcaanttttaccatangcantaaaccattccaagccttccagacagtctccatagccgcaccagcatgggcaatangctttaaccaaacgaaaacaaacaaacaaanggcacttcggcantttgttgctgccaaancggggngaggaaaagngtgtaccaaactttgntggggntcccancggtccattttnttttaggggggcc

SEQ ID NO: 2003 - DNA, 465 bp, Homo sapiens
  Genbank Accession No. H78628
  unsure (1)..(465): n = a or c or g or t
gatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttcttaagggaacttnggatttaattgggggggaaaaaaaagggagtacntgtaactngctttgatttttttttcctttggatggaaagatgggagggttaaagggtaagtgagggagnatttcttttcaagttatcta

SEQ ID NO: 2004 - DNA, 380 bp, Homo sapiens
  Genbank Accession No. H79820
  unsure (1)..(380): n = a or c or g or t
acacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggntcacaaggtcaggagttcaagaccagcctgaccaatatgggtgaaaccccatctctactaaaaatacaaaaattaggccgggcgtgggtgggcagggtgcctgtaggtcccaggctacctgtggagggtgggaggatttgcattggggcccaaggntcttcaacactggcacttccagcctgggggcaacagcgttgaggacttcccacct

SEQ ID NO: 2005 - DNA, 332 bp, Homo sapiens
  Genbank Accession No. H80901
  unsure (1)..(332): n = a or c or g or t
aatgattttatttttaaatgtggacaggcaagcagaggtggttggcaaaggcaaggtggctgacgatccggaagctgtacaggagagataagggcactggctgccagagtgccctatcgaagcatcatccgaaccctgcggtaggggtggcccacaccacggcctgaggccagttcaatgccatatttgtgggcggcactcaggacactgcatagcgaccattgagatttgatcggtaacaggatgcataccaccaggcaccgtggacaatcactgcanagttgctgttgcttgaatcgtggtcagcgtcataggtgggtaaagggcctccc

SEQ ID NO: 2006 - DNA, 340 bp, Homo sapiens
  Genbank Accession No. H81070
  unsure (1)..(340): n = a or c or g or t
caggtctaaagtgtttaattatcactcacatatttcacaggaaaaggaatgtagcaaatgggtcaaggtggtataaaaaaaaaatccaggtttgtacatgtctctctgtttacatctgggagaaaggttgtcctgggcatcagtcgcagcagctgcacttctctgacgcccctttgcaaacacagccctggggcacacttgctacagcccacgggnagncagggagcaggcagctctttcttgcaggagggtgcatttgcctctttgcacttgcgggaaccagcgcggtgcagggaggacaccagcggcgcagggagcagttggggggtccattngcaag

SEQ ID NO: 2007 - DNA, 419 bp, Homo sapiens
  Genbank Accession No. H81413
  unsure (1)..(419): n = a or c or g or t
ngagccagaaaaggattttttttaattcaagtaactgaaataggaaaccagagggggagccccaggctgggataaatcatggctacccctccccaacagaacagggggaggaggtggcccctacacccattatggtcgattcgggcccccttgctcactctgctgcagcatcctagaggcagggccccaccttccctgggactggggtagtcggtcacccagcctgcattgccccagcccctnttccccacaaagagtatcttgggggagggnttcgtggggcagaacaggagggcaatgagggatgaacattgctcaaactcctttcaaaggggcacctgaccgcacaggggaggntgggcaggaagggcaagggntgggggatgccgtntaaggagggcggangcaggcanttttgg

SEQ ID NO: 2008 - DNA, 411 bp, Homo sapiens
  Genbank Accession No. H81964
  unsure (1)..(411): n = a or c or g or t
ntattgtttcattgcaattttttccactgtactttcaaaaccaaagaaagatttaatatctaaacttgcagactgttcaaaacaggtccaatcttcattttcagggtgaacggtgtagcagcaatgctcattaatgatgacccgattggaaaacgtttcattataagcctcaatgtgcaaagtacgttcccgagaattcagtgagtttttctggacaaaataaacataatcaactcctggcaatcttcttcagcagtctgggtgcatctacatccaggcttgcagcgcctttcaatggacatgaatagccccatcttcggctcttggaatttcattcacagtggtcactggcccacggaacatcgggaatcaaagggacatgtaggggaacctcccttncatagggcaggc

SEQ ID NO: 2009 - DNA, 305 bp, Homo sapiens
  Genbank Accession No. H82424
  unsure (1)..(305): n = a or c or g or t
ggtgatattcttcttgctgtcaatggtagaagtacatcaggaatgatacatgcttgcttggcagnactgctgaaagancttaaaggaagaattactctaactattgtttcttggcctggcacttttttatagaatcaatgatgggtcagaggaaaacagaaaaatcacaaataataggctaagaagttgaaacactatatttatcttgtcagtttttatatttaaagaaagantacattgtaaaantgtcagganaagtatgancatctaatgaaagccngttacacctcaggacaatatgattc

SEQ ID NO: 2010 - DNA, 425 bp, Homo sapiens
  Genbank Accession No. H82735
  unsure (1)..(425): n = a or c or g or t
attacactgcttcggctggacacgcaaccatgtgacactaatgtgtcatagaaggtctctgagcactttggctcattttgaatataatttttaaaaatatacacaaggctggctttccaatgtttaaaatcattgtagaaaccaacaggttgaacagaaatataaaagtacagaaaatggttttcctgctttggtgttggttgtggcggccgaggaacgtgactgctgctgtttacacaagtccagacgctgccagggcctgttgggatcagctcagtctgtgactaaaacagctggatcatcgactctcttgacttgccaacaccaacccatttgactgcgactcccacgtgattctccacaaagcggatgtagttcngggcctgtgggggcaggtcctcccaactncngggcgctgtggtgtt

SEQ ID NO: 2011 - DNA, 452 bp, Homo sapiens
  Genbank Accession No. H82966
  unsure (1)..(452): n = a or c or g or t
annattananntcaataatattagcaatagctattttcaaatcatgtaaatcataactatctttaatatactgatcaaattgtatcatatatgtctgcagttgagatagttttncattaaagttgattttggcatcatctaatgcaatttgtatatcattttctgtaattctatacttttttgtgagagcagtcagtttctccttggcatgtgaaacttgtctctcccaattgaatgaattcagataatcattagcttgctgtggggagttttcccaggggctgctctgtatttncttacaaatngatcaatattgatggtgcttcagggtttctctggtacgttttcccggtacaactataaggggtttgtcgattccctctcaaaatattcttggcaagggnctcaaaaatgggggagggttaanggggagtggaaccatcctggggttt

SEQ ID NO: 2012 - DNA, 286 bp, Homo sapiens
  Genbank Accession No. H83109
  unsure (1)..(286): n = a or c or g or t
ttttcccactaaataagaaaactttaataagatgattacaaagaaattaataaagaaatagaaaatgatagcagcttcaaaaataccagtctccctgttttaaaacaaantcantaaantcagngaatcacaattcattgaactcattcttggctacaaggaagcagctggntagntccnctggcaggcagccctgcaggnttaaantgnggcccactgccaaaangccccaantgngatgccgtcctcctcatcctcacaccatcctcatcaggcagggaaggat

SEQ ID NO: 2013 - DNA, 307 bp, Homo sapiens
  Genbank Accession No. H83442
  unsure (1)..(307): n = a or c or g or t
aaaacatgatattagtatataagataatatagctagccagtgttagtaaagaagtcatgattgagtcttaaaaaagaacaatccagtgttgcagttcagagaggttagcatgtcagggcgcaggctcggcganggatgtgctttgcatttaggacacagcccggagccgcagaaggtcagcaggagcacgtctggcaccttcagtaccaggctgggtgagagagcccgagaggggngccgggggggcagtcagggccctgcttcgctgnctgggcccttgtagatgggccttntccagggccgntcc

SEQ ID NO: 2014 - DNA, 312 bp, Homo sapiens
  Genbank Accession No. H83451
  unsure (1)..(312): n = a or c or g or t
gacatatgaattaagtggtcaaatgtaaaactaatggggacaccaagcctcaggaagaacatcccatgtttctgtttaattctcttatgtgttatactaccttccctttctctttcttatacacatagattttccttaattgcagcccaagaggacactgccccattttgttttgttcttttgtcattgggacttaaagtgggtgcctcaagtctttggtaacagttttaacagaacactggacaatgactgggatatcaggtcagtggttgganctccttcccaaggctactggtctggnacactaaggat

SEQ ID NO: 2015 - DNA, 353 bp, Homo sapiens
  Genbank Accession No. H86072
  unsure (1)..(353): n = a or c or g or t
aaacatgtttattagaaaagtaaaaaatattgcataggncttaatacttgaacatcaagtgtattcatgaacagtgagtatcttancttcatgtaaacagtnctagatggaagacccagatggcactcctcccggggngggntnccagcccccaccctctcagcccctcccctgccagctcaactctgcagtacacgatgggggaaggcttaaacgcagctgccagggggtaatttttcaagtgtcaaagancccaagtgatccctgnacacccaccccttcctactcttacattcatgcggtctgtaagataggctgcctacaacagggtcagtaggngatggctccgatcc

SEQ ID NO: 2016 - DNA, 323 bp, Homo sapiens
  Genbank Accession No. H87144
  unsure (1)..(323): n = a or c or g or t
catggcaatcttttattacttatttttnatttcattccatgttggaagcaaagtcatatctattaaaaagtaaaaccacaaattagtctttgattattcagangcataagangattgctgttttcatgttttccatttttccctccagtggcttgaaaagtacagatgctcttttcagtcatgttttgtcttaaagattttaaaataggaggagtctgcatccacaccactcttaaagttctcaatccttttcttccccatcttgttgggntatccaccgggnccgggntgggcatgtattgccacaaatatggttactanca

SEQ ID NO: 2017 - DNA, 283 bp, Homo sapiens
  Genbank Accession No. H87765
  unsure (1)..(283): n = a or c or g or t
ccctttattaaagcatcaatcaaaatacagggtgggtcacatggttttctgtttttgctactgtaataccaacttatatgagtaacttgtttacaactttatttttaaaagtgaacattttacagttcacagaatcaccagattgacatttctgtcgagacatttttccnttttccaattttaacaanggacatccaggaactactgaaatacaacaaacggaaatctanggtgcaaggcntcttccntgattctcattgttaggcagctctatgggggtctg

SEQ ID NO: 2018 - DNA, 349 bp, Homo sapiens
  Genbank Accession No. H87790
  unsure (1)..(349): n = a or c or g or t
anatattttaattttcattcatacatatattgtgtggcagagaagtatgacaaagtgagcaataaaacactttcagccataaaagtaatgcattagtataaaattctatagggcaatggaatgaagctacacattaaagaggaaagaaacaatgtaacatttcccacaattaaagcggactgggacgnagcctgaggcaacatgaccagaccctgtctctacannnnnntacannnnttaggcccagcatggtgggtgcgtgcctgtaggtcccaggctattcggggagggctggggttgggggnaggatcacctgaggccngggggnagtgggagggttgccggtgga

SEQ ID NO: 2019 - DNA, 227 bp, Homo sapiens
  Genbank Accession No. H88033
  unsure (1)..(227): n = a or c or g or t
aaccatagacccaaagcccttacgtttgatgcaatttattnttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaa

SEQ ID NO: 2020 - DNA, 293 bp, Homo sapiens
  Genbank Accession No. H88359
  unsure (1)..(293): n = a or c or g or t
tttttgccagagctaaacaatttaatataaaaaatgccattttttgtccatacagtatttataaaaaagtacatagtggttagttttgcaataatttctttttagccagatgtcatatcatcatataaatctatgaatataacaaatgacataagaacagtataaataagtttttgtagtatttacacttacacagaaactagcccaaatggtgtcctaagaaattgtttacagttaaagtgaaactactgattcaacatactgacactccaatgctttttaaagtttcgnat

SEQ ID NO: 2021 - DNA, 397 bp, Homo sapiens
  Genbank Accession No. H88674
  unsure (1)..(397): n = a or c or g or t
tttatggtttttatttttcaatttttattttggttttcttacaaaggttgacattttccataacaggtgtaagagtgttgaaaaaaaaattcaaatttcncncggngcgggggaaggagttaatgaaactgtattgcacaatgctctgatcaatccttctttttctcttttgcccacaatttaagcaagtagatgtgcagaagaaatggaaggattcagctttcagttaaaaaagaagaagaagaaatggcaaagagaaagttttttcaaatttctttcttttttaatttagattgagttcatttatttgaaacagactgggccaatggtccacaaagaattcccggtcagcaccaccggatgtccaaaggtggcaatatccagggaagggcaggcg

SEQ ID NO: 2022 - DNA, 374 bp, Homo sapiens
  Genbank Accession No. H88675
  unsure (1)..(374): n = a or c or g or t
aattttaatagataaatgtaaatttgactgtgtaataccaaatggaaagtagctgaaccacacagagaaaacaaggctttacgtatctccaaatttagctgttttacaataaacaaagtattagaacatgtgaatattagaacctccttctaactggaaagatttcttcagtaagctataaccgaaattaatataaactaaaattanaatttctaaaataagaattaacaaaccaaatttaagtatttttagtcagagattgaaacaaaataagcacagtgatctagaaaccaaatatactggnttatgtaactatcgtatcaaggtacagacattcttcacatggctacaagggttagcatttctcctcgtgg

SEQ ID NO: 2023 - DNA, 445 bp, Homo sapiens
  Genbank Accession No. H89514
  unsure (1)..(445): n = a or c or g or t
acaaaactttattggtaatagttttcaaatatgtttacaacagcacactgttcaagaggaagtctcgtccttcgcagcacacaggttgaatcgcccccgcacccacccggggccccaccccaggcctgagaactcctcctgggatggggagaagttatgagagggggaaatacggggatgaatggggtggctcccccncggctccccacttttctattacgagagaaaaaagcacaaatgagaaagtggggggagagggtgatgggacagctgacagctaagctgggagggagggggcgcccgggatngggngagggcggaacttgggtggggtgagtaaaacaggcagcccctccccagcagcttttagcctttnaaccccgggccntggttttggggggattttggcttttctntttcccttttncagggatnccttncccat

SEQ ID NO: 2024 - DNA, 278 bp, Homo sapiens
  Genbank Accession No. H89551
ttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaa

SEQ ID NO: 2025 - DNA, 428 bp, Homo sapiens
  Genbank Accession No. H89893
  unsure (1)..(428): n = a or c or g or t
aanttacnttttagccaacttttatttttatgcctagaaaaatacatgggacgtttaggactaatgtgctgggcaatttgctacttagtgatagtaacacaatcctgaaaaggcaagcacaattattctgtactttttaaaagttttattcagcaataagaccataatttttcatatttaaggagtatgaaaaatttgtggagttttaaaagctgaatacatgtagcgttggatcaaggcacatacaagactggccaaagggcggtacaatgcactttggttttttgttgaaaaaaaaaaatcatgggcaacagaaaagtgatatggtttttcaacaagtaacagctcacaattcagtaggaagctagaaggaaatgttacattacgagttcnttatataatatccgggaaatttgtgacagtaatgt

SEQ ID NO: 2026 - DNA, 292 bp, Homo sapiens
  Genbank Accession No. H89980
aaagtgagaagctcatcaaggatagctagaggagagtgaaatatttacagtagaaaagtatggatgctagccaaacttcaaattctgtcactgcagagttattccgatagtacttttccaccatggcacatcacacatgttaaaattaactgcattcttgtaacacctctcaatggttgtgcacaataatagaagcaacattctgggactctttttcttaagatcctacagaatgaatttatgcacacacaaaaacaagtataatacaaaacattcaaaacaagtcacatcc

SEQ ID NO: 2027 - DNA, 351 bp, Homo sapiens
  Genbank Accession No. H89987
ttacaaaatccaaaataattttattcacattttcagatttttgcttccacaaggtgttcagcaaacatgctaaggcgacagaatgtctagttggtcacgacatgcaacgctgaccattcaactgatgacagcagtgaccacgcccacctgagctaccagccccacagcacaaagggggtttgcgggaacacaccaaaccacacagcaaccagcaacctgaggtaggtctctttacagtacaaaaacttctacgccagtgtgagacactgattaggcaagagctgcttaaagttgcagactttgaggggagagagagagagagactgtgcgacgactgcggtgaggaaaggg

SEQ ID NO: 2028 - DNA, 392 bp, Homo sapiens
  Genbank Accession No. H90417
  unsure (1)..(392): n = a or c or g or t
ttcacacagaatgcatgtttcacctctgtaacctaaaaatgtttacgataatttaaactaaattcatgccattttatagaacacatagtattgcatacaggcaatttnccactatctgtgcccctggaagaggcagagcacagatgacttacaacagaattctaaagctcttttaatgctaanccaaatcactggtatttgacttaagatgcattttgttttttaactccgntcactgcattttgcttagggttatantaaattatnntgtggccccaaagcttgacagatgtcaggggctaagggtgcttggaattaaaagggggaaattaaatnaccagtaattgaaagttggacctttaaaangtgcntacaaacccatcatcaggagg

SEQ ID NO: 2029 - DNA, 432 bp, Homo sapiens
  Genbank Accession No. H91325
  unsure (1)..(432): n = a or c or g or t
canatttttatgtttcaataactgatttattttttaccccttgtacttaagatttaacatgtgttgtatttccagcagttcaaatctaattgtgtcgaatttccaggattggaggaaaagttgctccctttcagccctcctactagaagcactggagctaggctggcgggcattggaccctagtaggtatagcaggctgtgaagagcgactgggtggaagcagccccagaagaacccgtgtgaacatactgtcctttggccgcctggcaggttagccatggcccggcttcataaaagcctcctgggttgcctccttgtttggcagccttgccaccccaggnagccagnggcactggncttggnagggcccggtccataaggggaaacctnagttttccaggggctttgggttanaaggggnaaagggtggtt

SEQ ID NO: 2030 - DNA, 378 bp, Homo sapiens
  Genbank Accession No. H91456
  unsure (1)..(378): n = a or c or g or t
agatattatacatacaattttatttgttatttcctgaggcatcctctgtttgttatatgaatccataataaaatgtagaagagtctgttgatctggggtgagttcagttttctccctgcatgactttgttgtcgaggtcacttgtcgcaagtcacgaccttcactgtcttcattcacggnctgatctgcatgctgcttcacatttnntctcagtcgcttagatttacactgaatttcagnnaacaagccggtatacatacattcagncaacattcccagcnctttgcatttcctnagtcgacactcttgacactttcnncgcangtacatatccancacacagttggccccgtttttacacttggacacagnggtttt

SEQ ID NO: 2031 - DNA, 304 bp, Homo sapiens
  Genbank Accession No. H91632
  unsure (1)..(304): n = a or c or g or t
actttattagcctggagctcctccctgccagccccagggcggtacgactggtccctgggcacagtgagcagggctgaggtcagacgggttcggcccttggcattggcagcttggttgggacagccgggccaagggaaaaaaaggtgcaaaagtccaaatgctggcacttcaggtgtggccggcacccagccaggcgcagtgggtgggcagggcgccatgcttctctcctggcgacaggtcggccgtntagcagcgccccctcccagcagccactaggaacagctggtgattctcgccagggaac

SEQ ID NO: 2032 - DNA, 357 bp, Homo sapiens
  Genbank Accession No. H91680
  unsure (1)..(357): n = a or c or g or t
cttggaaattgacactttatttttaagctctattacatataattcccctccccattcccagagatactcaactattatagattattagctaacaaaacaaaaaccagngaatgttgtaaaaatgttcaagttcagtaagaggctatgttttctagagacaattctagngttcaatttccattgactttgttagattcattggntagngaaatctttagntctganggttccacgttccagatgttttgggcatatnctttaattgttcggncactgggagaatttccccgagggcagctatgtttttgaggtaccattgtgttccggggcctttgggattcatgtacagctgactca

SEQ ID NO: 2033 - DNA, 546 bp, Homo sapiens
  Genbank Accession No. H93021
  unsure (1)..(546): n = a or c or g or t
aagagaaacacccgtcaaatttattgcagttgtccagtcagcaatggtgatcttcttgctgattgctgatcttgccattcttggaccccaagtgctccatgacctccacaatattcatgccatctttcaccttgccaaagaccacatgcttgcaatccaaccactctgtcttggcatcttggcagggcagataaaaaactgggaaacgttcacgctgggtccagcatttgccatggacaagatgccaggacccgtatgcttcaggatgaagttcttgtcatcaaatttctccctgcagatggacttgccaccaatgctgtatggcgtgtgaagtcaccactctgacacgtaaaccctggaataattctgtgaaagcaggaacccttataaccaaatcctttttctccagtgctcagagcatggaaattttctgctgtctttggaaccttgtctgcaaacagctccaatctgttaacatagttttatggattagatgagcagtcacttcttgcnttccaggncccctacctcgaaggagacacagcc

SEQ ID NO: 2034 - DNA, 547 bp, Homo sapiens
  Genbank Accession No. H93053
  unsure (1)..(547): n = a or c or g or t
gagactgcatagggctcggcatggtactgtagccagttcgtcaataatgcatttttctttctgtagaatgtctagttggatgagtcagttttacttccactatattttactttcctaaatgctgatccaagtaactctgggcattcacataattcatttgcaatttggttacacttcaaaataaggctataattcatttcatcagttatgacactgtcttgcttgtagtcaggatggtttgcgataaactccctcatccatctggcaactgtcattagttctccagatgctctcttcttaattagctttaggtagttcagaatactacatctggtgtccacatccactntccatggtttcaaggtaagagttcccgaattgggatcagtccaggaaacacaccttccttcccattgatgatggtggcnatgcncatgagggtggactcctctgcagcgagctccgtgctgttccgggccctgccacaaccatccaccactgcattgccacctttgcaanaaccttcccggaataaacattccngcag

SEQ ID NO: 2035 - DNA, 316 bp, Homo sapiens
  Genbank Accession No. H93246
  unsure (1)..(307): n = a or c or g or t
atccctggtgtgttgtgtgggcctctttaacgtttccactgagccttaacctcactgtacttcactgtacttcacacgcattggtgttaacattttaatcttagaagaccctgacccactgagggtttgttgtgagaattgctgaagccacgtagaagcaccttgaaatctgtnaaacccacaaagaaagtactttataaaaggtatccttatttgaagtggataaatcttgtaactcgaaaagttgtgatttagaagacaggattgtttttgaacattaggaattaaaggctatatctggtccttaaaaaaaaaa

SEQ ID NO: 2036 - DNA, 397 bp, Homo sapiens
  Genbank Accession No. H93381
  unsure (1)..(397): n = a or c or g or t
ttattttttattttgctatagctgcaatgttcacagtaatccaagttccaatggcagggtggcagagtggaaccaaaagaggccaagttttgttggtgaagtataattattttttaagatcagggattcagaattgtagtatcagtgttcagttaggaagttcttatgatagtgcatggcnatgtcctttccatcatctgcattttctgctttttttgtctggctcacttctactcactctctaatcctcaccttagtggtcacttctccccggaatgtccctgaccccttatgatagcagtagtgcaaacaccaaaggctgaacttacaaccagactcngcaggcaacaccttgccttgtgccatgcttcaatccatgaagaggatgtgagaaaga

SEQ ID NO: 2037 - DNA, 363 bp, Homo sapiens
  Genbank Accession No. H93492
atgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttctttgatttgactgttatttctgaaaaggacacattcttgctgatacttgtaacaacctgttcaaagttgtggaaatcaccttctgttggctttctgacatggacttccttgcagcactgttacttcttaaaaaggaacagaatggcaaaccagtggtctgggcccgtagtcccccattggattc

SEQ ID NO: 2038 - DNA, 416 bp, Homo sapiens
  Genbank Accession No. H93562
taaggcaggagtacagtggtgcaatcatagctcactgcagcctcaaactcctgggctcaagtgattcttccattcttccacctcagccaccatgcccagttaatttttaaatttttttgtagagacggggggtggggctcctgctgttgctgaggctggtcttgaactcctaggctcaggtgatccttccgcctctgtctcccaaattgctgggattacaggcatgagtcaccatgcctggccagcaacaatttgtgttttgagaattaacctgagccatttcctgaagctacctacactgccattccacagttgggaatatcttcacgtatctaccggctagggaagaatctgggggcagaaatcaccttattccagagcagcaatttagacgacgtagtaggagtttgtaggga

SEQ ID NO: 2039 - DNA, 414 bp, Homo sapiens
  Genbank Accession No. H93652
  unsure (1)..(414): n = a or c or g or t
gctgggactgccccaaaggcnaaacnnggtttattgggcagcagctgggaaaatcagcggttggacttggccacacgctccagctcgtccttcttcttaatggcataggagttcgaggagcccttggcagccattgatgngctcatctgccaggcactcagcaatggtcttaatgttccggaaggcagcctcangagcgcctgtgcacagcagccagatggcctggttcanacggcgcaggggggacacatccacagcctgncgtctcacagncccggngcgcccaatgcgngtggagtcctcccggggaccactgttgatgatggngtnnaccaggacctgcanagggttcnngcctgngagnaggtgtatgatctcgaaggcatgcttgacgaagcgcaaagtcaagagctt

SEQ ID NO: 2040 - DNA, 443 bp, Homo sapiens
  Genbank Accession No. H93745
  unsure (1)..(443): n = a or c or g or t
ggaatttattgaaatacagtgtatcatacaaatagaatattcacatgaaatgatcaaaggaaggggtaaggagaaaagtattaaaactgaaaatttacctagtgaataagtggacataacaattgagaatctatccacttcatgtcacttatggaaacaacacattaagattaaactacatgtttgctagagtaggagaaagtatataccacagggaccatcattactctagagtgggtctatgcataactcctcaaaaagagggccatcgttggtgtttatgtggctaaaagttgtgtattttgggcttctggagaaccataaaattggactcaaagaatagtttcaaaggaggtaaaagaaggaaatgncgtggacaattggaaggacatgggaattnaaatgggnttggtcncccaantggccccttaggtaacccagag

SEQ ID NO: 2041 - DNA, 309 bp, Homo sapiens
  Genbank Accession No. H94247
  unsure (1)..(309): n = a or c or g or t
cctctttctctctttttaattgctatatattagcttagaacaaggtacaaaatttggagattcacaggaacagcacagaagtttaacaatattaataaagttctaacacatgacaggaaagtttatctgggntcttgaaggcaacagctggntctgcatgcacattnctgggagtcnagtggattcnggaanaggtcttctctccatggctccatcttgctctttcacaaaggacccctaggtccatggcaccataagcccagggcnagtgatttgnagcatggagaagggaatngaagggncccgcta

SEQ ID NO: 2042 - DNA, 395 bp, Homo sapiens
  Genbank Accession No. H94471
  unsure (1)..(395): n = a or c or g or t
tttgttacttttacatgatctttattatttaagaaaaacctcttttaaccatttatataacagaaaaaaaatagggaggctggtagatcatcacatatatagtagctaaaatatgaaaggccagggaatttattattaatgaagtcataaaacagacttaaccaaaagtgtgtgctaggaaacaagcagtttcacttcagagacttcattgcaggaacccagtttccttatgtggaaaaaagtgattataaataacagttatctgaaaggtggttgagaggattaaatgagatcacctatgcaaacaaatacatgtaggtatgaaagaccatccgtcctgggggtngtggaaagtttaagtttccccnccagaacccttccctttaagggcctta

SEQ ID NO: 2043 - DNA, 373 bp, Homo sapiens
  Genbank Accession No. H94475
  unsure (1)..(373): n = a or c or g or t
tttttgcccattcattctttattcaggtggcataaaaatcactacaaaaaccttacaaaagagccttaaggagctcatgggatccttccctgcctcggttcctgagctcccgggcagaggagggagacaggagaggaaggaagggaaatgctggcagtgttgggatctcgaggagccgtgggaagtctggcgtgacaaggcacagggggtaggatggaggctgatggactctcggcaggttaggccacagccaaggctgtgccangacacgagttccacgcggggctgaggacaacgcttcgcctcccgagccaccaccagggcccgtctctccccaccctaagcctaggtgtcccgggacaagtccaaaggc

SEQ ID NO: 2044 - DNA, 342 bp, Homo sapiens
  Genbank Accession No. H94648
gaaaacatagtttattttctcattcaggcttttgtagtttatttttacaaaatagcagacaaaatttggttctttatattaatagagaatatgtaagacatatcgaaatatatatatagcacttaagttataaacacacagcaaattcagcatcacttaaacagcaaccatattttcacataatcaggattgcataaggagataaacattatttttagcctaaatatataaataatctttgatgctttatgtcaattagtatttataaaagctagtctaaaaactaacaccacctacaaaagttgattgagctttaggctacaaccttgccatcatgccata

SEQ ID NO: 2045 - DNA, 408 bp, Homo sapiens
  Genbank Accession No. H94666
  unsure (1)..(408): n = a or c or g or t
cttcacatttattaattcctgggaggaatgagggaggcttctccagccccccagagaccccggccttgtgctgcaacaggaggggagggagccagtccagaatccccggcacttctgaggacaccaacagcaccctgggcccgcggtgcatcagctttctgccaccaggagctccacagggtcgctgagctccgattcgaaggtgtggggcacccaggagcggtagtcnacnctgtagttgccggcgtgctggggccccacgaagatcagctcgaggttcgccgcggccccgggggtgcggaccgtcttcacggccttcgtctcgccctcgcgcanagctccgaaggtggacgtcggggatgggtccctcgcagcgcaggacggcatctcggcccgccagaaccgccc

SEQ ID NO: 2046 - DNA, 402 bp, Homo sapiens
  Genbank Accession No. H95079
  unsure (1)..(402): n = a or c or g or t
tttaaactcagcatccatttttaactattgaaatttttttttttttgagacggancccaaggctgcagtgcantggcgcaatctggggtcactgcaagctccacctcccaggttcacgccattctcctgcctcaggtgcccgccaccatgccaggccaattttttgtattttttagtagagacaggatttcactgcgctaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagttta

SEQ ID NO: 2047 - DNA, 394 bp, Homo sapiens
  Genbank Accession No. H95089
cagaagccacatttcccaacttgtgttctaaaaataatttacataagataaaaattcattatatgcacagtatgtacagtttaattattaaactgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagagcaaaattgatggacctgaaaatgttttgcaaaatgtaatatagtctactgatacaatatttattattattgggccaataatgtttaatgccaagtgctaaattagtaaaattttggggatatagagaaaaatt

SEQ ID NO: 2048 - DNA, 331 bp, Homo sapiens
  Genbank Accession No. H95233
  unsure (1)..(331): n = a or c or g or t
tttattaaacttgtacattttactttccttctttcagaatgctaataaaaaacttttgtttatacttaaaaaaaccataaatcagacaaacaaaagaaacgattccaacatcacttctgtgatgagaaaagaggcaatggaattcaacataagcaaagaaaactctacctggaggaaagaaatcgatcagcgaggaaacaactcggggctgctgcagaactgcaggccatgcgaggaggagcctcctagaggatttccaaagcaaacccatccctgccagaccaggaaggcagccgtcctanctcccagagnaacagacctcagccctaat

SEQ ID NO: 2049 - DNA, 465 bp, Homo sapiens
  Genbank Accession No. H95358
  unsure (1)..(465): n = a or c or g or t
cagcttttaaatttttatttaattccatataaatgaaagtacatatgaatgctattatttgaatagttatttgggcatagacaaaataatgacaattgttcttattttggacaaaaagatgttttaaagtaatacagcatatatattattttgttaaatacatttgggcacttcttaaaatgatgggtgaatttaggaataaattatttttctgcaaactattcccaaaagaaacaaatgtggaacagtattcatatgagtttatttttgtgataaagtaaaaggacatttatacttttttaaagactgagccataattaagattatacccttaaaccttgagtatttaaaagacccttgggttacncctggtttacngggtccagaatttaaattatacccaagtttgagtgcnccacctcccaggaaattaccaatgccccntatacccaatattaggaagcc

SEQ ID NO: 2050 - DNA, 341 bp, Homo sapiens
  Genbank Accession No. H95566
  unsure (1)..(341): n = a or c or g or t
tttacnaactagataganacctttatttcacaactttatcatcattcacatnctaanaagacacggactgggggacacagctgaaaacagtgggaggccagatgctggatcntccagacgggagcatagccatggtcactctagccgatgtctcctggggctctcaggcggcaaggaccagattgcaccactactgtccaatcccagttttacttagagccacctccttttttggggccattantccttatttcatgccagattttcactagcggctcccngttcttccaaatcagtttcatgacctgtaagtaacataccatattccaaaaagagctccc

SEQ ID NO: 2051 - DNA, 351 bp, Homo sapiens
  Genbank Accession No. H95569
  unsure (1)..(351): n = a or c or g or t
tgttcctaacacaaatgtgaatttattggttgatttgatatttaaaatagtacttttacaaaatcatctcagaaaatatactacatttattaaaattcctacaaaccattgcagaaaatattaaaccctctaaccaacctaacactcgctttcagaggcacttgtgatgattttcacagcttccatagttgcaaagaacaaagaaatcatcttccaacaggggtggaattagataagaataatccaaaaaatatttatttctttacagactcacagattgcttgatgtttaggggctcttacctaggatacctaattattcaagggtttccnaatttagtagactttttca

SEQ ID NO: 2052 - DNA, 279 bp, Homo sapiens
  Genbank Accession No. H95978
tttttaaaaaattgtttaccctgtacatgtttctattgaatcctaagtacgaatgcccaaggagataaagcaagtgcagttaagtatgcatgggaaagctaaaatgggtatgtacataagatcggcaaaggaaaccaagttctgtaaaatgagttctccctcccctccagggtagctgattatgaggaaaataagaaagagctttgcttttctccttagtagtaatggtctacaataagctgcacacacacatccctcatcacacctctctgctcaaaa

SEQ ID NO: 2053 - DNA, 427 bp, Homo sapiens
  Genbank Accession No. H96392
  unsure (1)..(427): n = a or c or g or t
ttacagaaattttatttgagatctcaagtccttataaaaagtgcattacatcaagattgcaaaagacactttttaaatgngagacttctatctattcatccattttaccctatgattcatttcctaccctaacagaaangatgaaacagtttttctttcttccttttcttcctcctgctttgaaagggcaactgtcatgagggatatcttaacagaatgtgccaattaatccttgccaggagagcagtagcttcctacnggctaaatttagagagcccttggcattccttttggtgtggctcaaagattattacaagctgnatctaaaagattgcaacctacnacttggcaatctggtctcccngggctcctcttttactnacaaactcccatttaaaacaacnttaaatttaagcacgcaataatt

SEQ ID NO: 2054 - DNA, 451 bp, Homo sapiens
  Genbank Accession No. H96614
  unsure (1)..(451): n = a or c or g or t
ttttggttttcacatttttattgggagccgtgggagggcatcattaccttgggcacaggggcagaagagagcatagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctgggagagaggggctgggttggataaggaggggtttcaggactgatgaacgcttctgtctccaagccttcttggggaaacggtcggcaactggcttcagtttcaggactacaccccttaggcaatagcagtgggtaccgagtttn

SEQ ID NO: 2055 - DNA, 394 bp, Homo sapiens
  Genbank Accession No. H96850
  unsure (1)..(394): n = a or c or g or t
tttttgagggcaacatctcgctttatttttatttatttatttatttatttatatttgagacagagtcttaacactgttgcccaggctggagtgcaatggcgtgatctcagctcactgcaagctctgcctcctggattcatgcctttctcctgcctcagcctcccgagtagctgggaccacaggtgcccaccaccacgcccagctaattttttgtacttttagtagagacagggttttaccgtgttagccaggatagtctcgatctcctgacctcgtgagccgcccgcctcggnctcccaaagtgctgggattacaggcatgagcaccgtgcctggccacgtccctattttagaaatgagaggagtgactgcacataggaaaaatgccactttta

SEQ ID NO: 2056 - DNA, 420 bp, Homo sapiens
  Genbank Accession No. H96897
  unsure (1)..(420): n = a or c or g or t
acagttaaacatatttaatagaaatattaaaataatcattacacttcctctcattgcagaaaccatgaaagaatacgccttttgtaatcaaagtaattttttatcatgcaaaaaattattttgttatgacattcgtaagcagagactatatttcaaaacaagtttatacagacttcaaaaggtctaaagtcaaagagaaagtgaaatatatttaaatatgattagttacatcgtatgcagctggcatactcatattcacagtttataaagtaaaaaaactaaactcttcatgtcagctctgaaatagatgcattttcattaatacnttcactagttaggtcngttcntctaagacnggaggaaagatgagatatatgagccatttttaaanggacaaactccacatatcngcagccaatt

SEQ ID NO: 2057 - DNA, 437 bp, Homo sapiens
  Genbank Accession No. H96975
cactttatcttttctactttattacttcaaattaacaaccacgataaagctcaaaaaagtccaatatttacacaggaaaaaagtacaaaattccccccaaagttcttcagttttttttttttcagttttttaaattacaaagtaataaaaagctttgctctttaattaaaaaaaaaaaggaaaaaggggaaacagaggtaaataaattaggaaaacacacacacggagaaaacaaacaaaaataaaataaaataaaaacaaaaaggtgttaactaggaaggatgggttaatccaaaacccagccctgactccaggctcctcctcagaaaggtggaaccagggagaggggggacccagggttgactgtcaggaccagggaagtaatttataactcagccagatgccttctggaagcagtctccatggattctgcccta

SEQ ID NO: 2058 - DNA, 395 bp, Homo sapiens
  Genbank Accession No. H97012
agttattacagcaaatactttggtctgattgtctgtgtcttgtgacaagcgatagtgacccagtagaattgcatcagtcctggtattcctagttcttaaacgtggaacaatggactgaggctcttcaggggttgtcaacatcatcacatggccatcaggaaagaatcttatgtacctgtaatattccacttggtgccaggctctatagaaaccatcaagagactgttccccttgacgaatatatgtggttttactgatatacacgccatcaaaccgaacacgaggccgttctaaaaacatctctctccaggacgtgtacggaacaagtttaatacagcttctgccccaaactttcaagcaggccagacgccatatttcagggtctctggcacaga

SEQ ID NO: 2059 - DNA, 396 bp, Homo sapiens
  Genbank Accession No. H97013
  unsure (1)..(396): n = a or c or g or t
ggggagggcaacaaaaagatgagtggtttattgaaggtttggtctagatacttataaaaatacaaactggcatgaaattcaacctcatgaagagtccgtcttcatagaagacaagtgagtgatcccctggggagggcaaggtgctgccccagggaaaaggcccacagnacaagatggcagggcttcttctttgccctggtccagcaatcgacctgtccccaggtcttcagcctgggcccccagctggcttgaggatttgatcataccaaatcccagtcctcctgggggaatgggctgagaccctcagagcagccttgcaaagcgccttgtgtttgtctttgcctctgcttcagagtgtccagggctgtctactgctcttctttagcctgtnatgag

SEQ ID NO: 2060 - DNA, 592 bp, Homo sapiens
  Genbank Accession No. H97587
  unsure (1)..(592): n = a or c or g or t
ctttcaagatgagctgtatttattactggaacggaagttgtcatatccgtgatcattagctttgaactttaagcacgactgcttttcctccaaggactgtttttcttcaaatgactggcaccagcagcataagcatgacttaaagcagtttttgaatcttttgctcaccaaatacagagcaattgggttaatgcaggaattcagtgaagccatgttgataccaatatagtccaataccaacagaaagctcaaaagttcacatctattgggatcattctgattataaagagtgagcttcagaatcctgctgaggtgaaggggaagccagcagagggcaaagaccaggaccaggcaaaagaccggnttttgggccacttnccggctctggctttagggtggtccatttaaagcaatctgcatgccacttttccttctcaacatttcacaggtcnttagtgtataaaaaatgcngtgatggccatgnaaagccggaattgnactggacagccaccatcttttgccggcctggnaactggctgnaagctgtcttctgaacnggatgagccagccagttccccgatacttccnttgt

SEQ ID NO: 2061 - DNA, 431 bp, Homo sapiens
  Genbank Accession No. H97670
  unsure (1)..(431): n = a or c or g or t
acaaaatagttcacaatatttatttaacaagcgttgcattgaaaacaactttatgcacagtgaagcaaccaacaataagcaaacagaaaggggtggtaaaaacagtacgttcacttttcatttccttccttggtttggattacacatattcttccatccttgcatttttggagctacattattagtccatccaataccaaagtgagcagatacttgatcccatttctggaaaggaaatgtccatcttggtgtaggagttcttgaggcagctggatttactgcaaattaagtaaacctttaaaaacggcattgtcacaggctatgtgttctctgacatgccaggctggacaggtgagaagagcctccaaaagacaaaacttcttcctggtttaaagaaacagcacactaggccagataaacnccaaaggaaa

SEQ ID NO: 2062 - DNA, 436 bp, Homo sapiens
  Genbank Accession No. H97677
  unsure (1)..(436): n = a or c or g or t
aatggaatcataaattttatttcaaaatgtaaacgtcactaaacatgcatacacgttaaaacaataaaatttacaatttcgttaatttttctttttgcataggacatcattacaatatagaatctatgccatacaaaatacatacaaagttttatccgagcaagccaaggccagactgggaactgtacaactgtaatacttcactgtagtgatccaggaaagatgaaacgtggccttcggaattatggtgggtgctggttaaaaaaaagttcctacagaaaagaaaaacatgagctccatggaaatggtcttggacccttggattctgccttggntttttggcaaatgattccagagaagctccaccaatggctttggatgggaaggggntgcctgtgcgggcctggggcagctgagacccggaaagcatgcaccc

SEQ ID NO: 2063 - DNA, 422 bp, Homo sapiens
  Genbank Accession No. H97809
  unsure (1)..(422): n = a or c or g or t
ctgtttcatccaattttattcttttncataaaagcaatgcagtaaagataaaactaaatgtggaccctgggaacaaggagtccagaggttgcccaaagagtcgcaaagtgcatcaggaaacctgaatgtgaagatcggtgaccgagagcctgatgccagcctcctcttgggtcttgactgaaatcttcccaggttgctattggattttgcatgtacgagcctccatcagaggatagacttaggcatatggtttgcccagtgaattgaagaatctccagagtttatgaattgaagagtgggatgaatacaatacacagagcaccgaagcaaacacatcagaatcgaggcaactccctgtttcgttcaccatgaagaaacatctgtgaaatcaaagtcatccccggtggaatcaggctgcttgg

SEQ ID NO: 2064 - DNA, 543 bp, Homo sapiens
  Genbank Accession No. H97868
  unsure (1)..(543): n = a or c or g or t
cagcnagctgtgctttattgacaatgcggactggtatgtacgaggccgaattcgacttcagagaagcactggaggacggtggagaagaagaggttctcggactttctccgtgactaaggacatgcgaggttaaagttgtcttcttgagaacttcagaggtcagtccaggctttggatctgctgcagttgaactgggtaaattagaacctgatagttgagtggaatggggaaacagtaacgtcgaggaggtgcccttcgatgcagaaaagggtgtagagtgagcggtagtttgaaaatacgtagctgattcttccaccacggccccaccgacatccagcctcctagttgtggaactcctctaggacagaggctccctcgaggttaactgggtcgggtggtgtgttcggattagttggagaaacaaggagaaagcaggtggtttacaggcaagctgctcagaggtagtgggagaagaagttaactgcccatgcttttgctgaagggccatcccatgaagcattcaggatgtgatgaggtcttgag

SEQ ID NO: 2065 - DNA, 426 bp, Homo sapiens
  Genbank Accession No. H97986
accccattgtagaagaggaataatttatttctatatgattttaataatgttccctaagtaattagtaatcaagattttcttcaaattcaaattaacaaatatgtttgttaatctaaataatatacatatttatgtatttatatatgtatatattttaatctttctgtaattcagtctttaactgtgaacttttacatgatggaagcagtgaaggactcaatgtcatagtacattttgatagtatttgataggctttttcaggtcaattaatttagttgcttgcaaatataaatcaagcttgctccagttccacaaggactccaccacagtctttaggatggagaaaaatcactggttttccatgtgctcctattttgacctcttcacttagactgcggatcttcttttttttcaaatccatcacag

SEQ ID NO: 2066 - DNA, 596 bp, Homo sapiens
  Genbank Accession No. H98071
  unsure (1)..(596): n = a or c or g or t
ctgtattatacgttgatacagtacactgccaggtgaaacaagagccttaataaagcatgcatcgcccacacccctgtatgagacccccacagaagggatcgcttgntaaggcaccattatgaaggtcaacagtgcattaacagctagaaaaccagaaattagtcctcaaggcataaataagagaaacatagctgcatgagaaaacagtttctaagcgttagtggttttatccacccaactgagaaaaattttaggttcttaagtctaatgaaacattagaccagcaattcccagccccagctttgtgacactcaatacgtgtccaatttcttctaaggggcatcacagaattctccaaaaagttaattcaaattcagaatcatttnaaaaataatcctgtgttggacaatgcctttctggaaggggagtgttacaaacttggagggggaaaaaaaattgtatattgccaggcccggntggctaggggggtccctgtnttagcagatgggatcttagctgctcattactgggatccgnatgcagtcctgacttaaaatggaaaggcttnagttccccggncatgcatgacttttgnt

SEQ ID NO: 2067 - DNA, 440 bp, Homo sapiens
  Genbank Accession No. H98083
  unsure (1)..(440): n = a or c or g or t
aagtcttgttccccatttatttttttgttgtgattcagaaatacaaggtatgaaaattagattacaattctgccacaaaagcttctaaagtagcaaacacaactttgtgtatcaaaatagccatgtgcgcttttatcagttaaaaagtctttagagttatcacatcaagcaagtgtaaaatataatagctactatctccccttcaaaattgcaaatccacagttactgcactgaagtataatccgaagagcaagatttagtccagaatatggaaggttctggttggcaggtactttttaaagctgacttactaagaactaaaagaaatgagaaatatacaaagcatcttatgtcaaagagtatgaatatttaaaagtggcctcaagtgagtaatacatgtttaaattagaaccngatgtaattaaatggttatggaattt

SEQ ID NO: 2068 - DNA, 440 bp, Homo sapiens
  Genbank Accession No. H98657
atacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatggttctgagctggggaagcagcaggaaaaataggggccctttcccatg

SEQ ID NO: 2069 - DNA, 251 bp, Homo sapiens
  Genbank Accession No. H98771
  unsure (1)..(251): n = a or c or g or t
nttttgatatataaggccacaatatttattttggacaaaccccttaaagtagcgattttattatcaatgttattcattcttttgaaatataaagtacttcagctgaattaaggttgcnganaatttntaaaatacaacacacatcatgactagtatattaaaattatttatattcagatatttatatctaatatcaaatgaaaatttactaccanatttttacagtagacattaatcagtctgacatgctt

SEQ ID NO: 2070 - DNA, 437 bp, Homo sapiens
  Genbank Accession No. H98822
  unsure (1)..(437): n = a or c or g or t
atatttcnagtgaatcatttaatgtgagtgaggctcagttaggtgttaccataagtattaacagaagaaaaagggaaagcacaaacattttccctctaccagaaaagggtctgatgtaagataaactagcctgttggtttaacaatagctcattaaaaaggccagagaatctgggagaagatgtacttggaagcactgtcctctgagggcccattcccaagggacagcaaaatactgaaaaaaattaactggctcaaaaattatattgagagataaaaagagttagtcacagcttagaaaaaaattccagaataaatgacactagctagattagtaattctgatgtttccttgtcatagtactctgtgcgaaacagagggactacaaactggtgcccctttgaacagagtggttttaaataatagattctccagtgc

SEQ ID NO: 2071 - DNA, 432 bp, Homo sapiens
  Genbank Accession No. H98910
  unsure (1)..(432): n = a or c or g or t
tccatgtattttattgtagaacgataggtaatcttttgactttctgaatacatttgaatatgtactgctctgctttccatattttaatgcaaggccatgatttaatgtccatttttatactcttgtaatgtcatgtcattacaaaaattttttagaacatggatctgacattatttttatattttatcattaggtttgtttagtttatttttacatgtaaaaatgtaattttatataacaagccatggaagtccaaagtaccagggattgcttgatagcactatatattaaataatcattcaattacctgaatcattttaggnaaaaaaaacctttgtaagccatatggtcacatgcctttccagtaatcntcccttcctccatagagtggggttttaagcnccaatccattccccaattttaccggatttt

SEQ ID NO: 2072 - DNA, 433 bp, Homo sapiens
  Genbank Accession No. H98924
tcagggctagagaataagtttatacactgcctcgttaggtccaggggcccgcgcacgtggccaggcgggtggtcctgacgcttcaattcatttacaagtattggattccacgcctgctcctgtgcccgcagcttccccaataggccagcaatctcaataatgctttattaaagggcagattcatatgcggctcttgggggaatttttacaaatatcaaaggaactaatccagcatcctatatagaactctgcacactttgggggaggtccgtgaagcaggacaaagtgctctttacacagggaattgagtcggttcaaagtatctgctctgtggggaggacaccctaaagcattctacatacgtcacccctgctctcaggatgcacccagtgggctcgccggtcagggtggccttgcggtgtccacccccaca

SEQ ID NO: 2073 - DNA, 522 bp, Homo sapiens
  Genbank Accession No. H98977
  unsure (1)..(522): n = a or c or g or t
gaggtctgggaggtgtttaattccacctcgaacaacttggcaaggtcagcagagaagcaaatggataaaagtacttcacaacagcagaaaagttccatcaggggcgcgtgattcccacaaaaccatggcaatgtgtcctactctcaggaacccacaatggagggcggctccggagattttccatgaggcagtacgaggcccgtacatgcaacgctgctgagccccgcctcagggttgngtactggccgccccgagtccccgaaacagcgaccancagggggccaaggccgacagccctgacccccgcctcctccggggtgtgccccacttgctccagacaagacagaccccagcgtgcgggcatgggaggcggctgccaggccacggcggggtttcctgctctcggagtcgagcagaggcaagtgaaacaaaggtcagtgaacaccgaggtccagagcanccgccgcctctggaaccttcccgagtcccaagggnccgttacgagagtccttgcggcttcgt

SEQ ID NO: 2074 - DNA, 332 bp, Homo sapiens
  Genbank Accession No. H99261
  unsure (1)..(332): n = a or c or g or t
ggaaatgaacgtaaatttattgaaactggttttggggcaggggatgggtggacagctgggggttttccaaagagaactggaggagccagcgcccggccaggtgggagcgggtgcctggccacagaccctatctcaggcccagcttcttcttttccttctgcttcttgcggaccacgtccagattccggtccttccacatgctcttgcgaactttgatggggcgcgacaacantacttcccattcatctcacgcatggcgcgcacgtagtcgctggggtccttgaagctgacgaagcccgtagcccttggtcttgcctgtgcgcttgtcacgg

SEQ ID NO: 2075 - DNA, 458 bp, Homo sapiens
  Genbank Accession No. H99364
  unsure (1)..(458): n = a or c or g or t
ggctgagaggatttctttatttcgcgttcagacccaacacactcggacaccttggggccctgtgaggnttaagcagggtggtggcgtcagtcccggggaggccccactccctggggaggaaatacacggcagggggccgcacccagccccccacggagggacccgtgttgctctaacagggacactgaagttgcctctgccgccccgtgagnttgntgngcggccccaagacccagcccagccaggccagaggagcctcccaggggccctcaggtggtgaaggtgggggcttcccggccccggtgcccaccggcccttctaagctgcctgtgcttgggccaggtgtcctctgaggccggcaagaagttctggcccccgctgcaactgcgctttggtggctggcangggcggggtaaggaggtcaacctcgaaggccgggggttcccatgttgctangg

SEQ ID NO: 2076 - DNA, 363 bp, Homo sapiens
  Genbank Accession No. H99393
gagtgttaaaataattacacttaatattttaatagtgtgctgtgaaatacatagttttttgttttgttttggcaaatgtttcattttgttttaatgacttcggtccaatataaagaaaatgaaatacagtgaatagttcttctttcaagatgagctgtatttattactggaacggaagttgtcatatccgtgatcattagctttgaactttaagcacgactgcttttcctccaaggactgtttttcttcaaatgactggcaccagcagcataaagcatgacttaaagcagtttttgaaacttttgcccacccaatacagagcaattggggttaatgccgggaattccagtgaaagccaggttg

SEQ ID NO: 2077 - DNA, 397 bp, Homo sapiens
  Genbank Accession No. H99473
  unsure (1)..(397): n = a or c or g or t
tgaagtcaaaactgtttattaatatttggtgacaaaagaacttaaattgaccgaaaatcaaaagttacattgccttggtacagtgcgcctgggtttgtcaaggctgctgctacaaagctggagaacacagcacagggcgaacagaggcaaagcggcccagcccaacagccgggatggggcagggagcgtccctcaggccgccgcggggtcaccngananaccntacccggtgcatgcctctacgcggcctaccggaagaaaggggaaaccgaaagccctagagcaatgggaataaataagagtccctgccagaaggaaggttggccttgtgcgtcccccgtcttgttcccatgtagaaagccggnattcttggaggtgtttcggattcangggccaa

SEQ ID NO: 2078 - DNA, 456 bp, Homo sapiens
  Genbank Accession No. H99489
  unsure (1)..(456): n = a or c or g or t
gccttaacaaaaataatttattccacacacctcccaaggcagggggtagcgtgggaatcaagcatgtgtaaggcactgccccgccagacccttctaacttctgcacactggaaggtgaaacctggagagagaagacactcccctccctagcttctacctggcaccctccaaagatgagcattcatcttggagaccaaaataaaaaaggacaaaagaccaggctcagagggagcagaantcaaatggggggaangtgaaangcagccatcttctcctgcangctaagccangggcaanggcactagagacccacatccttcccatgccaccaaacttcgttcagggtcccagncaaggcaagccantttaagcctgnaaggcccaggaaaacaatgggtttgcntccanctggggngatcaggcacggantttccagaangttttcaaaaaccccan

SEQ ID NO: 2079 - DNA, 250 bp, Homo sapiens
  Genbank Accession No. H99587
acaatgaatggctcccaaagtcattttatttaacaaaggggtcaaggcagaggaaagtttcccttaatatccccacaactgctccacatgtcttctgtggaaacacttcaccaggaactagctcaacactcttgctaacaatttagtgtctatacaggaaggctggtgtctctgttacaggtggcccgttccttaaagcctttagggttaatcgcagctgcactgagtggccaagcagaccctgttggga

SEQ ID NO: 2080 - DNA, 403 bp, Homo sapiens
  Genbank Accession No. H99727
tatcctgcagtgaattttattgaattcaaaggtagtattcctatttgagaaatgaaaaactaaaatcaagttttacaagcaagcatcatgagataaagcagtgaagacgccttttcagatcacaccagagcagacaccagtttctaccccagcccacatgaagatgtttttattcaatacaaacagtaacagaggcaacacaatggccatagaatgagaacataagtgcatttgaattttttctgagttctggctataggctctgacaagcctatcattcttttcttaccaggtgaacagaaatcatctgctaatgccagaaactttaaagctcttaattccagctggaaacaactacaatttgaggggcctttatactaagctacttggcttccccaatttt

SEQ ID NO: 2081 - DNA, 407 bp, Homo sapiens
  Genbank Accession No. H99774
cattgaagtatttattacataccatcattggccaggaacagttctaggtacttgagttctagcagtaaataaacatgatcatcacagaggatgcacaggaagcatttaataaattcaagaggaattcagcctcatgaattatgaaatactgggaaatcattcatcatgtaaaaactggatataaaaagaaacctttcctgtaagagattagcctcttcaaaaaataaaataaaaacctacagccaagccaataaaatagagcacgtatctcagcagaactgcagacaattatgctggtattactgctattcattgggtggtgtgctggaggttgaaattagtccagtaaagcaagaaaatatatatataggtataacctaacgactaaagtggaaaagtaagagtcc

SEQ ID NO: 2082 - DNA, 456 bp, Homo sapiens
  Genbank Accession No. H99870
  unsure (1)..(456): n = a or c or g or t
acaaaaccaaaaaaccaaaaatattttattgctgagtcatcctggggttccataaaggaccccaagccttgcttggagtctatagctttgctaggactcccatgacatcaggatagagattgaggcacggggtcctttgggttccgattaaggaactatctactctgattctgttgatcttattagtccctccaggtcacctctacttcatctgtccgatacctctgtgtaaccccagaatcactgagtggggtcctgtgtccagcccgaaacatctcccagccagcctgggctatcatcgctccattgtcaatacagaatctctcatctgtaagcaaaaagccgggctccacgttcctgggcacattggtggccatcatctcctggtaagcctcacattacaccccactccttccacaatgaggggcagcattccgatngggctanatcctcnat

SEQ ID NO: 2083 - DNA, 452 bp, Homo sapiens
  Genbank Accession No. H99877
  unsure (1)..(452): n = a or c or g or t
cactacgtaaagtttatttttatatatatatataaaaaaaagtataacactggagcctaaaaccattctcttttgtagaatacatattggcgttgaaacagtttaaagaaatgaaatggctatctacaaaangttagttttgattgctgtcttcccccatactttgtgtcttcacacataaagaaaattttcaaagattttatattcagcaattttttaaaaagtacactgttttccactgctatggtctttataaaggacttgacttaaaatttcaaataaaaaagaattaaggttctaggataactcttgtgtcttttaagagcatctttatacagaacaatttggaccggcatgcaggcaacttcntttgttgttacataccnggtattagggaaaattacacccatttttacaggaaaatcccnaaacatatactggccataagcccc

SEQ ID NO: 2084 - DNA, 443 bp, Homo sapiens
  Genbank Accession No. H99879
ctgattacctacaatggtcaattttattacaaagaactgtatcaaaatatacaagtctgtttaagaacaaccaagaaatgcagctgtttaagggacaaatgagaatcaaccgttagagagcaggcagcctctccccgccgctgtccactgcaggagacggcatcctcagggccacattttccacgggacatccttctgaataatttaaagggtaagtccggcacattacaggtcttcgcgggagggcagctgtgtcgggctttctccttctgtggcttcagctcttgccggcggacaacaggcatcttccgtttcttcgaagccgtcagacacacacagacgtagctccctggagtattgtagcagttttcgtttttcctcacacaggttttttctgctagtgagcactcgtccacatctgcacactgtccgtgctccctcgc

SEQ ID NO: 2085 - DNA, 428 bp, Homo sapiens
  Genbank Accession No. H99935
  unsure (1)..(428): n = a or c or g or t
tcctttttgaacaggtccaatgatttcagatcttctggaaaaggctttttgtcatttgcttctatttccacaacacttacatcagtgaaattgccatctgaatacatttgatcttttgaattaaaattgtgccttggaggagtgtgaggtgaccactgggcaatatgactctttgaaggatctggaacattaggccagatgtgttttttaattaggtctcgcttattaaagcagaacagcactcccagaagagttgtcaataggaatgctaagcaaacaggcacgactatggcttcaatttctccttgagcaaactttggggtaagtaaaagtgaattcttggaccatccttcccacctttcatctgtgtatgctgccattccgtaccatggtacaatggtgtcactagtcaaaganggacaatgtat

SEQ ID NO: 2086 - DNA, 8966 bp, Homo sapiens
  Genbank Accession No. J00098
  unsure (1)..(8966): n = a or c or g or t
ctaaagaagagcactggtgggaggacagggcgggggaagggggaggggagtgaagtagtctccctggaatgctggtggtgggggaggcagtctccttggtggaggagtcccagcgtccctcccctcccctcctctgccaacacaatggacaatggcaactgcccacacactcccatggaggggaaggggatgagtgcagggaaccccgaccccacccgggagacctgcaagcctgcagcactcccctcccgcccccactgaacccttgacccctgccctgcacgccccgcagcttgctgtttgcccactcctatttgcccagtcccagggacagagctgatccttgaactcttaagttccacattgccaggaccagtgagcagcaacagggccagggctgggcttatcagcctcccagcccagaccctggctgcagacataaataggccctgcaagagctggctgcttagagactgcgagaaggaggtgcgtcctgctgcctgccccggcactctggctccccagctcaaggttcaggccttgccccaggccgggcctctgggtacctgaggtcttctcccgctctgtgcccttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacgggtaggtgtcccctaacctaggagccaaccatcggggggctttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaagtaaggacccagcctggggttgagggcaggggcagggggcagaggcctgtgggatgatgttgaagccagactggccgagtcctcacctaatatctgatgagctgggccccacagatggtctggatggagaaaccggaatggatctccaggcagggtcacagcccatgtcccctgcaaaggacagaccagggctgcccgatgcgtgatcacagagccacattgtgcctgcaagtgtagcaagcccctttcccttcttcaccacctcctctgctcctgcccagcaagactgtgggctgtcttcggagaggagaatgcgctggaggcatagaagcgaggtccttcaagggcccactttggagaccaacgtaactgggcaccagtcccagctctgtctcctttttagctcctctctgtgcctcggtccagctgcacaacggggcatggcctggcggggcaggggtgttggttgagagtgtactggaaatgctaggccactgcacctccgcggacaggtgtcacccagggctcacccctgataggctggggcgctgggaggccagccctcaacccttctgtctcaccctccagcctaaagctccttgacaactgggacagcgtgacctccaccttcagcaagctgcgcgaacagctcggccctgtgacccaggagttctgggataacctggaaaaggagacagagggcctgaggcaagagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaagcagcttctttcttttgggagaatagaggggggtgcggggacatccgggggagcccgggaggggcctttggccctggagcagggacttcctgccggatctcaacaactccgtgcccagactggacgtcttagggccaagatcgacgttggaggacctgctggacgcntggctgcttacgagtgagggagtagagtctgccttagcaaggctcaagtagaaaggaagtcacagcggacnaggcaaagccacagacaatccaaggccaggtgccctgaaaggggctcaaacaaggcctgcagcctgtctgaggcgggccaggaaacagcggttgctttagctgggagcagtcgggttccccgtccccagaggtgtgtccgtatagagccttctccagcccagccgctgtcagcgggcgggacggagcggggcgcctcagggagccagccactgggattggggtttggtcccgggtgcaagtgaagcgcttggagtttgcgcctgtcctcctttactaattcaaaaacctctcaaacagacacttcccttttcttctcacaaggccagtatccccctcccactactcccatcccgcccagaaacagccgcggcttcctcaggcacagcagtggaagccagtcctccaccccctgcggctccatgccatgccaccccctctttctgccagccctggcagaagctggcctgagtaagaaaattcaccaccacctcttgcaggtacatttttatttccaagatgctctcatatctgtgctctcactgcatcctcccttccccacatcctggctagattgccatcagacgcagagcatggatgaggacactgaagcctggacctgtgacgtcgcttgcccagtgaacagcaggatgggctaggcagcgctttttagaccctgcacccctggccatccatgattattgaaaagagtgtgcgggtcgggtgcggtggctcaagcctgtaatcccagcactttgggaggctgaggtgggcgtatcacttcagggccaggagtttgagaccagcctggccaatatggtgaaaccctgtctctactaaaaatacaaaaaaaaaatcagctggcatggtggcttgcacccgtaatcccagctactaggaaggctgaggcaggagaatcgcttgaacctgggaggcagaggtcacagtgagccgaaatcatgccactgcactccagcctgggcgacggagcaagactccagctaaaaaaaaaaaaaaaaaaaaaaagagtgtgtggcctggcactcaagttcacatgggtgtgcaggcatgcctgtgtattctcacatgacctccctgctcacggtccctccttgcactcatgtctgaatgtccccgctgcacgcacatggcttcacagatctggcagtgccttccctaccctctctctgcagggccttttgccccctcatgcaggcccctggataatcggccccatccccatgtccccatctccagtgtatcttagctaccctaggtaaaggagtgggctttttagttcctaaccttccagagctacaacagcagtcatccagccaggtctgggtgggaacattttctagatacgggtgctgagatctctcagcccagagagaagccctggggaattttcagagagaaagcagtctccaggtggggctggatgtactgatgccactgagatctgtaaaggagtccctaacacctgacataggagtgacaaaactgttttctgcaccaactgagcagaatacacgcagctgacctgggctcaaggtctggccctgccacgtgctggctctgtgatgctggccaagtgccttcgcctctccgggccacagttttttgatctgaagagtggagccctactcaagccatctgcagctctcgggctctctgacctgacatctttcgggtggtggggacacaaaggaagcagcctctattgggagaccttgtgcttctttttggtcccaggacactgccccccaccactccagtccggtcccaagggcccagtcagctcaactgtaatcatgacaacattgatcaagcatctttacgtgcaggtgctgtgccaaacggttcgaacgctctctcatttcaatctcacggcaaacctacggtggagggggtacggttgtatccactttacatgtaagaaactgaggctgatatcaagtggtggagccaagaatagtgcctcgttgcatcttactccaacctctagcccatccggcctcctcccttcacgtgcgcctaagagggctaggtggcctggataggggaggtcagctccacagttttgagtaaacacacacagtctcaactctgatgacacttaagtgccaggcatagtggctggcatggggcacacactcaagtcatgttgtgcagcacctaacagtttatcaaagtatcagcaaacttattgtcctgtttgaccttccgcacaaagctgtcaaggaaggcagggtacggagggtgattcctaccttagagatgaagaaactgaggcccagagactagcccagctaccagaaggtggatagagcgctggcctccatgcctgcctgacctggagtctgtccagtgcccacccacagaacagcctcggccctttcccatgcccagacacagatggcacacttgcgacggcccactcatagcagcttcttgtccagctttattgggaggccagcatgcctggaggggggccaggcatgaggtggggtaggagagcactgagaatactgtcccttttaagcaacctacaggggaagccctggagattgcaggacccaaggagctggcaggatggataggcaggtggacttggggtattgaggtctcaggcagccacggctgaagttggtctgacctcagggtccaaatcccagaactcagagaacttgtccttaacggtgctccagtagtctttcagggaactgaagccatcggtcacccagcccctaaatcagtcaggggaagcaacagagcagggcatgagaactcctctgtaggcaaccatgggacccacacccatgtccccactggacgacaccagtcaggaccacaccaccctctcaacttcactggacgacagccctgagacctcaggcaggaatcccccacagctgccaccctgggagaagagatatccttgcaggaaccccagcacaagtcaaaccctgccatctccaggtcacctcagatgtttatgcccctgggcctgaggcacaaagtgacagggtggggagatgtgaaaggtcaaggctgtcattgttttctgtgcaaacagcaccacctggagttgcacaacctggtggctctgagcagggtaggacagagggaggcagcctctcatttggaaagtcattggaggattgattagttgtgtgatctggggcaggtcacctaatcgctctgagcctcaattttctcatctgcaaagtgagaaaataacacctaccccaaagccggttctggggactaagaatgtttatgaacacctctgctatgccagctaatgccagtcagggtgaggtggagaagggagtaggggagaggagagtactgatgggcaggggcaggatgggagaggaaggacacacttctgctcacactggccccaggtcttagaacaaagcagaagcactcacgggcttgaattgggtcaggtggggcctcccaaggcaaacccctagcccagggtccccaacccccaagtcatagataggtactggtccatggactgttaggagccgggctgcacagcacgaagtgagtggtgggtgagtgagcaatacgcctgagctccgcctcctgtcagatcaagtggccttacattctcataggagtgtgaaccctattgtgaactgcacatgccagggatctaggtggagggctccttatgagaatctaatgcctgatgatctgaggtggaacagcttcatcccaaaaccatccccgctggcccatggaaaaattgtccaccacaaaactggtccctggtgccaaaaaggctgaggaccactgctctagccagaccttcagaaaaggaaaatggggccaggcgcagtggctcgtgcctgtaatcccagcactttgggaggccgaggcaggaggatcccctgaggtcaggaattcaagaccaacctggccaacatggtgaaaccccatctctgctaaaaatacaaaaattagctgggtgtggtggcgcgtgcctgtaatcccagctacttgggaggctgaggcaggagaatgggttgaacccgggagacggaggttgcagtgagccgagatggcaccactgcactccagcctgggtgacagagggagactccattaaaaaaaaaagaagaagaaagaaagagagaaaggaagagagggaaagaaagaaaaaggaaagaaagaaagaaagagaaagaaagaaaagaaagaaagaaaggaaagaaagaaaggaaagaaagaaagaaagaaagaaagaaagaaagaaagaaagaaagaaagaaaaatagaaagagaaagaaagggaaaggaaaggaaaatggaaatgagggctaaaacggcgcggccctaggactgctccgggagaaaggagggacctgggaggaatgcagtctcaactctgtcatctctcccgcagcagcctgacaaaggccctgtgaggaaagaggaggctgaagagcacaggcccaggggaggctggagcacctccattccattgttgggatctcaccagggcaggggcgggtgggaatggaggcagctggcaggggggatggggagggaggccagcgggtgtacctggcctgctgggccacctgggactcctgcacgctgctcagtgcatccttggcggtcttggtggcgtgcttcatgtagccctgcatgaagctgagaagggaggcatcctcggcctctgaagctcctgaggaaagagcagggctgagtggggtggatcggcctctggacgagccctggggctcctgcttgaccacccattggactgggatccccaagttgcctccaccctgcccccagcccagtcccaccaagtgcttacgggcagaggccaggagcgccaggagggcaacaacaaggagtacccggggctgcatggcacctctgttcctgcaaggaagtgtcctgtgaggggcaccccaggtccccatgcctctggacccctccctggggaggtggcgtggcccctaaggtagaaccttagctgggtctgccagaaggagtaggggccggctcctgctcatacgggctctcagaagggggactggtgagcggcgagggatcgaggcccaaaggaggtgggtgggatggagcagaaaacccaccagactgaacatcaaggcactgcggtctggactgatctccgtccagtccagccaacatgctgtgtgtctttgggtgatttctggccctcttccaggcctcagtttccctgtctggggtaggactgggctgtctaaggcttcctccagccctaagcctgaagaatgaggggggaacctgcacttggagccacttccagccccaccccctatgtagctttgggcaagtgacacctcccgggcctccatgttcttcaggttatgatgaggggtggggggcacccgtccagctccgaggcttccttagctctagcaagtgcttctccaggcttgctggctgggctgggcagggagctcctcttgcccctcttcatcctcctcccctcctctttcccctccccagagggcattacctggagcagctgcctctagggatgaactgagcagacaggcaggagggttctgacctgttttatatcatctccagggcagcaggcactgaggacccagggcgctgggcaaaggtcacctgctgaccagtggagatgagggcctgaggcagggtgtccagatgcagcaagcgggcgggagagttgggaaatccctaggagactgagtccacgctgctgtcccgccagccctgcagcccagatgagctcaggaactgggggtgggcctggggagcctcattccttcctagctgactggctccccagggagaggctggtgagaggggaaatggcttggacataggccagcgctcgggcccatctcagcctttcacactggaatttcaggcccctccctccaccagccccaagccctgaacacagcctggagtagaggggtgaggggcttcttcagacttgagaacaagtgggtggcttgggctggggggtgtttggagtaaaggcacagaagaccgggcatcagtggctcgcaaggcctggttacagggctgagctcacagcccctcccagcacctccatctctgggtttcaatccaggcaggcgagtgctgctcacccagcagccccccacccgcccccaccctgtgtgccccaccgccgcctccccctgagtgtagggcaggggttggtggagaagcgcaaggccgctcagagcccgaggcctttgcccctccctccaccaggctccctattttgccctctggacccactgataacatccctgggggaggagcccccaccaggactgattctctcgttcaccttcctgggttcctcagtggggctgggggaagagc

SEQ ID NO: 2087 - DNA, 1089 bp, Homo sapiens
  Genbank Accession No. J00231
  unsure (1)..(1089): n = a or c or g or t
cctggacctcctgtgcaagaacatgaaacanctgtggttcttccttctcctggtggcagctcccagatgggtcctgtcccaggtgcacctgcaggagtcgggcccaggactggggaagcctccagagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccnnngtgcccagcacctgaactcttgggaggaccgtcagtcttcctcttccccccaaaacccaaggatacccttatgatttcccggacccctgaggtcacgtgcgtggtggtggacgtgagccacgaagacccnnnngtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaagccaaaggacagcccnnnnnnnnnnnnnnnnnnnnnnnnnnnnnnnnnnnngaggagatgaccaagaaccaagtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaatgagtgccatggccggcaagcccccgctccccgggctctcggggtcgcgcgaggatgcttggcacgtaccccgtgtacatacttcccaggcacccagcatggaaataaagcacccagcgctgccctgg

SEQ ID NO: 2088 - DNA, 14776 bp, Homo sapiens
  Genbank Accession No. J02843
cccccattgaaaaattgtctttctgatctttataaacaattatttaatatccagtaaaatcttctctatattgctttactagtgagttctattaaaattttgaagcacagaaaattcccctacagtataaagtatccccagtcacagagaagacaggggttttgcaatgatttctagaatagtgcaatttttatgcaagaacctaatataacacaaaaattatagcccgattttatttgtgggtatagatgcaaaattactaaaaatactattaacaagttgaatccttagggtgttaaaagagtatcactccatgaacgagttggttgtgatgtggaactatgaggtacttttatgatacaatataaaaatttatggtaattttatggtacattgtgagacagtgttttcttctagcatcatactagcaggtctatggagaaaaatcacaggattgtctcaatcaaaaaaagatttcattaacccaactctcatccctgataaacactgttagttatctagagaaagaagaaaattgtcccaatacagtcacctctttgccacacccagccaacagcagacgtgatggaagcctgaagaacaccctgccacgggcacaggcagaggcacaggcaccctgtcgtcctgattatttcaccttgtcacgggcagaggcacaggcaccctgtcgtcctgattatttcaccttgtcacaggcacaggcaccctgtcgtcctgattatttcaccttgtcacaggcacaggcactctgtcgtcctgattatttcaccttgtcacgggcagaggcacaggcactctgtcatcctgattatttcaccttgtcctagagtgtcctgccaatgggacagatgcaaaacaaataaaagccccggcttctgaaaagaagcacacagaaatgtcattattttcaaacgaggtgttcccgtatataaaatttgatgttggttgggcatctaacagtattatggccagaggactcagaccacagctgcatccctgtgaggcacagactctccagggcacgcgggtcccgctgggatgtgcacactcaggtgagctgcacagacaaggtgtcctcagcccaggggagccagaggcctgctctgcctctccaccctgatgcttcctgttctcaccccaccaaagccaaggcttcaatttcagtctgtggggagctgactctgctgctctcaagcactagaagaaggaaccagtaatcgaggaaacttgtggaccccaatggtgtctgtcccggccaggcctggctgggcccacacaggacaacagggttcaggggtctggacagctgtttctgcccagggaattgtccctgccacctcacactggccactggaaaggaaagagaggaggaggcggcaggctaacccacccgtgagccagtcgagtctacattgtcagttctcacctcgaggggtgccaaaaaccagagggaagcaaaggcccctgaagcctctgccagaggccaacgccccttcttggttcaggagaggtgcagtgttaggtgcagcacaaccaatgacttgcttatgtggctaataaattgtcaagagaaaaactgggttagaatgcaatatatagtatgtagtctcatttttgtataaatacaagtatagaatggcataactcaaaatccacaagtgatttggctggattgtaaatgacttttattttcttcatttctcatcatattttctattatacataaagattcattgttaatataaaagtacaaaattgcaacctatgaattaagaacttctatatattgccagttagaagacagaatgaaaaacattctcttcattctaaccacacacacaaaaaactccacaaaatacctatggactaccttcatagaaggtggaagagggtctgtatgaagaaaatgcttaatacatgaaagaagaagctagtcaatgtggaggtctattgtgcgccgggatcaacaaagacaagatatgtttaaaatggtgttctaaatttaccctaatgtaaaacaaatccaataaaactctaatgtgattttttaagaatttaaatttggaataattccaaagaacaatttttcttaatttctacagccagaatatatacctttaaaaaaaatgaaaacagagattaactttctcagaattggttgactcactctttccttttatttttcttccatggaattttccagttaacttgagaaagtggaatcgaattccgatgttgaattttccttctggccccattcatgtggcaggtggtgattcaggtactactgggggctgctcagacaaacctcctcatcagacatcaagaggctgttgcaccaggagggccggtaccgtgtctagaggtggtcggcatggggttggagttgtattacataaaccctactccaaacaaatgcatggggatgtggctggagttccccgttgtctaaccagtgccaaagggcaggtcggtacctcaccccacgttcttaactatgggttggcaacatgttcctggatgtgtttgctggcacagtgacaggtgctagcaaccagggtgttgacacagtccaactccatcctcaccaggtcactggctggaacccctgggggccaccattgcgggaatcagcctttgaaacgatggccaacagcagctaataataaaccagtaatttgggatagacgagtagcaagagggcattggttggtgggtcaccctccttctcagaacacattataaaaaccttcctttccacaggattgtcctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccgggtaagagaaatagtgttgattttagggagaataactcagcaattggatctggtatgtgtgtattcaactcatttgcagacaaattgtggttgttcaataccagcctgttgtgaattacctgaattgatagcatcctggagcgacactcaaaatgtgtcgcctgtggtgcagctggagcccggagcctgcgtgccaggccccggaggcccccgccgtgccttgtcctggggctgatgatggggaggccggcgaggccgggctgctgcgacgccaggataaccgggctggcggccagatgcgcactcgctgggcgtccgcctgtgtttgccaaagcacgagttgaaacgtgaagtgttgggccagcccgtgtggcaccaatacctgccgcctacgactgttgtgaacactgaatgggccaacaaacctaaacgttaaatgaactgataacgccgtcagcacggagcaggcgctgggtgtttgcgctcttgcgcgtgcgctgctgtggggcgcaggctgacggcgggcgggggtcgcctgctccagctcgggctcccgcgccagaaccgggtccagaaccttgattccggaagcgggcaacggggtggttggtgggcgcgcctgagggaagggacgtgaggagccggagtccgcggagttgccgcggagttgtccgcggagtccaggcgggtggggagcagagcagctggaaccccccgagcgccctgcagacgcagcagcctcttgaggggagggtctcccccacctcgggctggacaaagacagcttttccccacgtccctctgggttctctagagcaacagcaatacccgcccggcaggtgtggcttagagccccgcacctcctcgccgcgcgcgggcctgacttctagccacgggtctccgcagttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggtgagtccgcgtccctggcacggagcggggggtgcataacacgccccgggacagttacgggcgctagccacgtcggcgatggccaaataataaactaacagtaatattatagtaatagcatccgaaggatgagatcaggattaggcgatggcccccgcgcgttgcctgccgagcgaggcgcactgagtcgcccaggaatccggcctctcggcgactgtgcgggagagttttatggggatgggcggggctgcttctgagcaggagtcgccgcccccacccccaccgttccgcctctgggccgcaggctcctcccgggagcgctttcccctcctgttcaaccgccggggtacaggtggcttcgtccaccgaggtcccctcacccacgctgaggcgtcggaagctgcggacactgctcgcttcagggctttgctcagctgcagctggtgacctccagagagggagtctctgatgtcccgctggggtggatgtcctgagaccgggaagggggaagagacccactgaaatcctatctcccagcctcacctctgctgtctcctccacgcttcctgtctccagagccccgagttcagcataagcagaaagcggcctgttccctctctagggagaggagggttgcggtctggaggtctggctcgtctttatctgcgcattctcccagcctcctggcttcagacctcagcgaggcggcggctgcggccggctctcctcttcctgcctgcagacctggcctgctgcttctttctccttcctccctccctgcctgccctgcggtttcaaagtagattagaaataacagtgtcccacatggaagcctctacttcttcctgggtcaactttgatgacgaggctccagaaaacctttgcaatgctgtgtggaatttttaaatcggtgagctcgtgctcttgccctatttatttgtccagcgtacatttctgaacattgtgaacgtcgaatgggccaacaaatctaaaaattaaatgagctgataaagaacgccgtcagcacagagcagacgctgggtgttcgcgctcttgagcgtgcgctctgcggggcgcgggctggtggcgggcgggggtcgccggctccagctcaggttcccgcgccaggaccgcgtccagaaccttgtctccggaagcgggcaacggggtggttgtatcacaattagtggcatttggttttccttcttctgcattgtgggttttacttctctggggttgccaaaaacaaaattaaccatctcagtccttgtcgttaacgcaggagaagcattactggaggaggctctggggttctgtggttgaggagctcagttctggttccggggagcccttatctgccacccacgggtccaaggcacagtcggaggcagcagggaggggagcggaattcacatcaacacagatggggctcaaggggactttgctgcctctgcctggagggtctaaagtttcattttcatatgacccgcagggcgcagactggcggaaaattagcagagccctgggcatgggctgcacctggccttaagggacaatgatggaaatattccttattagcacaatactgagcacaggctgtgtgataatgtgtcaagggaactgcagacatcctttcagaaaaagttcataaaacggagaaagtttggttcccaacctagatttttaacctgttgaactctgtctaaatgggtcatctcgggatgtcctccactcaacatgaccacagtctgcccctctgtcccacctgtctcctcagtccttcctccccacctttcaggatgaaatgaaaccctcagtccagctgcacccctgccccacccacctcatctcatgtgccctcccgcccctctcaggccggacagccttgcttctggaacacacgagcacagcttcaccaggcactttctgagcaccctgcaggcgcctcccaggagtggtcagtggtcaatcagctaatgaagctgcataggacatgacccttgtttaccgcagaatgcccagagctggcaggatgtcttatatgcaggaagtacccaaaatgtatttattgaggaagtgatgatggataagaggaagacggagagcgagggagagaggggctaggggccctgcggtgtaaagggggtgtggctgggagtgtgcaggggaacagggatcatttcaaggttcctatctgggagaaaataaaaaggtttacagttagttgagataagcgtgggaatatgcgaacatttttaaagaataaaaagtttagctttaaatttgttgattccaaatgtgttcatactctcgggaggatccatcaagcaactcttgggaggagagacagggcagggcaggccttgacagctcagaagggcgcagtagggacagttcttggttttcccagctctgatgctttgcacagtcgcttgtgtgacctgcaagattttagtgaagaaacttgctgtggagtcggaaagctgcaagttgaggtgtgtgtggtgtgagggttaaaaatctgtgagaacagaatgaatggcttttcaagaatgttgtcgatagataggaaagaggtgggaggtgttcttggagtggccatatgtggttttatgtagcatggggaagactcagcagaaaggaaaaagaaagaaggtaaattgacagcatgaagtagagcacccaggagaggctacatgtgatgaagaaaccacagtgcagactgtgaggaccccagaaaggctcctccccaaaacctgaccagtggccggtgctggcagctcccaggctgggacaccctctgtctctctgtccctctgccccctctgtcacttctttatacacctgtaaatcctgccctgctctccaaggccctctgtagcccatttctccccaaaatgggtatttagaataaccttctgctggcccctctgccttaggaatcatttttaataatggacctacctggaaggacatccggcggttttccctgaccaccctccggaactatgggatggggaaacagggcaatgagagccggatccagagggaggcccacttcctgctggaagcactcaggaagacccaaggtgcgtatctgctgcctagcagggcccagtcctcttgcagaccagcggtgtggggagccctggctgggactcctagactgcatctgaaccacagggacctacggacaaggagagggtctcgtgagtccccagatactgcattttacaactctaggttccagctacacagttcagggagcaagggtggccattaaacacgtgacttgtatcctaaatactgttgaaaagcaaaggaaactcaaacaggttcagacattcactatctttcgtaaactggcagttttcagggcaccttctcacaggccttggtgaacctcagtgggtgactgagcaggtggaggagtctcctcacccccatcttctggttgccctgactgcctgttttgtaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccaggtgaagccactttcctctttcatcagtcatcaactgtagagtttacgttagaaaaagaaggaaaatttgggttatatgtgatagacaggactgcaaaagccaaacaacatagcttcgaggggtgtttgattagacagcccaaatattcctcccagagacatctctggggccccacgcaccccctttcctaacgtcaggatgtgtatcgacctgtgtgtgcacatttgccatgcagagtttgcactgctgaggagaatggtgcccaagaaggacactgttgacccaaaatattccaaataaacaatgattacagccacaaattcaggtttggagaaagttgttggtccaacacacacaattatgttgcatccagaaaaaagtagtaaaatatttttttccctctctagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggtaggctcggcctcccatgatgtgggctctccggggtgggcagagaatgcacaatttcagatttacagagtgagctgcacttgctggtgtccagacctcccaccgcagcatgctctgagtttcatacacacactcttggcttcagcatgaccactggacgcaagtcagcctgcctggctgccaagctggcctggggtttggggcacatgggcgggacgcttagctctctccaggccctgctgctcaaccctttctagtctgcagactttgagaattgcattttgtctgaggagaagccctcagccttccttgtgggcatgcactccccaactgtgcgcacgtgcaggacttccaggcctccccagcttcatccacctgcaggtgctcaggatcctgatcccctgcccccttcccaccttggtgaaacttcttgtatccttgtcttgtcctttcctatggcttgtggctcaagaacaaatgtggagcccacactgatttcccaggactgtctgagcatcttctccaccagtttggcccctcgtggcagcagacactagccctgtagcaggaggggttagcaggagccgtttagctcctgcctgagctatgaccaaggtcagggggatctcacctctcccaggatggccctcatgctgtggagggagacagagccctggcctgccctcagcagatttctgggagcctcagtttccctggctgtgagtggagatgactctgtctgtcacagctccaagtcacagttccactgggagagcctcttggacactgtctcctgtgtccctgtggagctgggaggtggctggttctgtgctgaaaggagacaagcagccccttctctccggtctgtctccggtatcacaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaaggtaggcaagtgactgaagggacaccgtgcgtgcggctgcatctccctggatggccagccttgcacattttaggctgcagctttctgtctgaagctgcttgttaaccctcatggtgatgtggtgagatggctggatgcactgctgtgaggggaggtgttatggtctgtgctgaacactggtactcttgcacactggttggtccataccccactaagacacccctggttgcagaaaagaacatcccaacaccagagtggagagaggtggcagggtctgcattctgctccataaataacctctttatgacagagaagataatgtcccagttccccccaagtaagacctggtcttctaggcagagcaggtggggaggttggagctggaggggagggtccttgctggggcgtcttcctcaaatgcggacgtgaggagggaagtccaggaagaagcagctacagctccccctggacccttgtcgttccttccacagggctcctcccagcggcacctggggcagctgggactctgtgcctggaggaggtgtgaaaggtctgggtctaggtgggcagagggtcatgccctgagaaacacccatctgggccaagtagaggtgatgtgagggcaccgcatgcaaacaggccagtcagggttgggtccaagtaaaggggaggaaagggagctgcagcctggctggagagtgccggggggcccagagcccctgcctctcgctgggctggaaacagggctgggcagcctctgcccgaggcagttcacagcctgagtggtgtgtgccgccctcctcctgaagctgctgctaatggtcacttgtggtcttaaggctcgtcagttcctgaaagcaggtattataggctatgaagttatttcccccaagaaagtcgacatgtgatggatccagggtcagaccctggcttttcttgttctttccttcttcttcttctttttatttatttattttttttttgaggggacagggtctcactctgttgcccaggctggagtgcggtgatgcaatcatggctcattgtagcttctacctattgggctcaagcgatcctcccacctcagcctcccaagtaactgggccacaggtgcacaccaccacacccagctgattaaaaatttaaaaaaattattttggctgggcacagtggctcatacctgtaatcctggcactttgggaggctgaggcaggcgatcacgaggtcaggagttcgagaccttcctggccaacatgatgaaaccctgtctctcctaaaatacaaaaaagtagccgggtgtggtggcacgcgcctatagtcacagctactcaggaggctgaggcaggagaatcgcttcaacctcagaggcacagggtgcagtgatccgagattgcaccccactgcactctagcctgacaacagagcaagaatcagtctaaaaaaaaaattgtagagacaagttgttactatgttttgtaggctggtcttgaactcctgggctcaagtcatcctcctgccttggcctcccaaagtgctggggttacaggtgtggccaccgtgccccatccctggcctttgctttttcaatcacatggaaatgtgaagggtgaaggagccaaaagtttagggaaggaatcattgtatggatctgcagtgattataagagaactttcgactactctgcactaggggaaccatggaatcaaaaaatgttttaaattattatttatgaggaggttccaatatagacaaaaggaaaataaatatgattgacatgtatatatccattgccaaattgaacgtttattaacattttgcgatacttccatcagagctcttaaaaagaaaatgtgttacagagccagccaaagtctacctcctcacatctccccacctctctcaccagaaatggcttcagaattgctgtgtggctttgcacttttaacagttgttaattatcagcacagtattcatattattgctgtatgtgtttaatattttacctgggtactgtacataacattttgcagcttggttttttcactcaacatatgatgatgttccatgggaactccaaacacggggaggctaggcgacttgctcaaggcagctgttacctctgtcagaaagacagaggctttcagattcaagaagtagaccctgcatgtctgattctgttctgtaaacccccttcatactcagaagcatgcaataaacaagcctggggtaattatcaatgcaaaggttaccctcccagaagaaatttccaaaacactttcattattctctgctcttgacatgaagagaactgaataagccatcatcaactgagataatggatgccaaaacatccagtaaataacctcatagagcttagctctcactaagtttttggagcattttccagtaattcaaaggacctggggaaccttaagcactgcttaggatgctccataaacatcttctgcgtgggtaggggagtggatggatggctggatgggtgggtggatggacggacggatggatggatggatggatggatggatggttggatggatgggtgggtggatggatggatgggtcaatggatgtgtggatggatggaagggtgggtggatgggtggatggctggctggttgggtgggtgggtggatggatgcatgggtggatggatggaggatggatggatggatggaggggtgtatagatggaggggtggatggatgtgtaggtgggcagatggataaaagcgtgattgaatagatgggtggatgatgggtggatgcccaactggccaggaaccaatccctgaaatttgtcccattcatatcttggcagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaaggttaagcaatgagcctgcagcacacagcatgaacaccatcctatcactaatcgccttcctgccagggagcaggatgggggccccaagacccttccctttggcaggggtcactgaggggaagggctggccccactcccaccctgtgggatactgcatctccaggagtgctcacattggcctggtgaccagagaggtggaggaaatctggaaaagagcctcagcagatagtgcctgggactgtagtgaattctaatgccaggaacaaactatcacaaccagccctggggttaatcctgtgagaagattagggctttcatcttcatttagacctgacccctgactgctttctatctaatccttcactaagcaactccttcaactcgaaatatactatcctatatagcataatattcaaaacaacattcttcactgggggtttccagatgaaagcccacattttgttaacatgactcactgagacagtctttgtttctcctagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggtgagaaagatcagaggcagtaccttcccttgaggagcagcccacactcctcatctcccctccacatgtgctctgccctcgtcccaggcacccactgacaccccaaacctcactgtgtgccctgtttctattgacaacatgacccaaatgtgctcttccctgttcagagaagttacataacatcttttagcagcaatcctgggaatgaagtgttgtaggtggattttttttttcccaaagactagacattttacatcattcattgctaaattttgtttctattttaacaagacttagtgaaaagctctcaaagccatattacccaattctccctaattttaaaccagagctactaaacaaaacctaacctttggttacctagaatcatcacaggaagcatcaaagccttcctgggatgtgactcagtgattttctttgaggcacttgtcctccttcccagggcctcatcttagggattgttgtgggaagatcatacaaccaactccatacttttcacacccagtgctggagccccagcttctaacagggcactatttccctcctgtaggcatcactgatgagcactgggggtgccttctttactgggcagacatggtcttcccaacttaacaccggtttttgcagttgagctctggataattgagattgtatgaaggctggtccccgaattagtcagtgtcgctggtatccttccactcaagtacattttgtgcttcttttaataggcagagaggggtgagtcctgccctgtgatggccgtttgcccacagcctcctcctccccgcttcccctagtctcactgttaacagtgtcgtgtctctgaaactccctcagtgtctcatcaataccattgttacttctaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactatatgttaagtcatggaatatcttaattgtttaagtgattctcacagagaggtttttttttttttttttttttttttgagagttttgctcttgttgaccaggatggagtgcagtggcatgatcttggctcactgcaacctctgtgtcctgggttcaagtgattctcctccctcagcctcccgaatagctgggattacaggcacccaccaccatgccagctaattctttgtatttttagcagagacagggtttcaccatgttggtcaggctggtcttgaacccctgacctcaggtgatccacctacctcggcctcccaaagtgctgggattacagcatgagccaccgcgcccagccagagagaggttttaaatatatatgtttactttaatattaagttataacataattttcatgttattgaaaagctcttccatctaggatcacaccacttcagtgtcagaatcatattgaggtggggaatttgtattagtcaggtttctctaaagggacagaaacaataggatagatgtatatacgaaagggagtttattaggagaattgactcacatga

SEQ ID NO: 2089 - DNA, 976 bp, Homo sapiens
  Genbank Accession No. J02888
cccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgg

SEQ ID NO: 2090 - DNA, 1422 bp, Homo sapiens
  Genbank Accession No. J02943
cagcctaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgactatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgactcagagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgaccttggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctg

SEQ ID NO: 2091 - DNA, 2133 bp, Homo sapiens
  Genbank Accession No. J03040
cgggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaatccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgaaaaaaaaaaaaaaaaaaaaaaaaaaaaaa

SEQ ID NO: 2092 - DNA, 1356 bp, Homo sapiens
  Genbank Accession No. J03242
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 2093 - DNA, 2060 bp, Homo sapiens
  Genbank Accession No. J03459
ctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagatgagctacttcttc

SEQ ID NO: 2094 - DNA, 5416 bp, Homo sapiens
  Genbank Accession No. J03464
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggccccgttggagcaagaggagagcctggcaacattggattccctggacccaaaggccccactggtgaccctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggaggcaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttcaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagcggttactactggattgaccccaaccaaggatgcactatggaagccatcaaagtatactgtgatttccctaccggcgaaacctgtatccgggcccaacctgaaaacatcccagccaagaactggtataggagctccaaggacaagaaacacgtctggctaggagaaactatcaatgctggcagccagtttgaatataatgttgaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 2095 - DNA, 3890 bp, Homo sapiens
  Genbank Accession No. J03507
atgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtccaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccatggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttgaagcgattcttgtgcctcagcttcccaagcagctgggattacaggtgcccgccaccacgcccagctaatttttgcatttttagtagagatgggtttcaccatgttggccatgctcgtctccaactcctgacctcaggtaatccgtctgccttggcctcccaaatgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaagatgctattcttc

SEQ ID NO: 2096 - DNA, 1116 bp, Homo sapiens
  Genbank Accession No. J03592
ctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacagacacgcgttctggaggtactttgcgggcaacctggcctccggcggtgcggccggcgcgacctccctctgcttcgtgtacccgctggattttgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaaca

SEQ ID NO: 2097 - DNA, 17509 bp, Homo sapiens
  Genbank Accession No. J03764
gggacatctagctatgtctagacccattgaactttcaagtcttcgaggcttggtactgcctgatccctgttcccctctgatccttaaggtcagagagcaaagccttggggggtactttttttttttttttttgagacagattcttgctctgtcacccaggctggagtgcaatagcatgatctcggctcactgcaacctccacctcccaggttcaagcgattctcctgcctcagcctcccaagcagctaggattacaggcacgcaccaccatgcctagctgatttttatatttttagtagagatggggtttcatcatattggccgggctggtcttgaactcctggcctcaagtgatccacctgccttggcctcccgaagtgctaggattacaggtgtgagccaccatgccctgtcttggggtacttttgaggacaagagttaagttcgggactgggcatgttggcttatacactttgggaggcaaaggtgagaggattgttccagcccaggaatttgagaccagcctggtcaacatagcaagactctgtctctataagaaaaataataattagctgggcgtggtggtgcttgcctgtagtccccgatacttgcttgagcccaggagttcaagtctgcagtgtgctatgatcacatgactgcactccagccttggtgacagagtgagaccctgtctccaaaaaaaaaaaaaaaaagagatgggtttggggctggacttgtcttcttccaagaggtcagggcagttgcttcttcctcaccgctaaccacactctcagggactccaaaccacaactaagaaaaggaaaaagacataaacaagaggcagtttcacaggaagagttctcctaatgtgtctgtgagcctaactttccgactgtggttctcctctctttccctgccagctgtgagaaagcaaagcctaaggcagattaaaaagcaggagggctgctcagtgtggttgcccttggtatctgtttactgaaaaaattcaaaacaaacatccgacgcttccacccactgaaacttcctgtgactctgctatcggctgttgccatggattctcccaactgaaccccaccacatacactaaacccaacagtccgtggaccccaagtatgccatctctccaatacaggaccccctgggcagcaccctggccacccttccatccacaacatccagaccacacggccaagggcacctgaccctgtcaaaaccccaaatccagctgggcgcggtggctcatgcctgtaatcccagcatttgggaggccgaggcagccggattcacgaagtcaggagttcgagaccagcctgaccaaacatggtgaaccccgtctctactaaaatacaaaaattagccgggcgtggtggtgcacacctgtaatcccagctactcgggaggctgaggcaggagaaccacttgaacctgggaggcggagattgcagtgagccaagatagtgctactgcactcagcctgggcaacaaaataagactccgtctcaaaacagaaaaacaaaaaaaacaaaaaacaacaacaacaacaaaatccactagtctagccctacatgctcacccactgctagccagtttccaccctctacagcagaggtacccaacctctgggccaggggcccgtactggtccatagcctgttaggaacccaggctgcataaccaggaggtgagtggcaggtgagtgaaatttcatctgtagttacagccactcctcatcactcgcattaccaccagagctccactccctgtcagatcagcggcggcattagattctcataggagctcgaaccctattctaaactgttcatgtgagggatctaggttgcaagctccctatgagaatctaatgcctgatgatctgtcacggtctcccatcacccctagatgggaccatctagttgcaggaaaacaagctcaggctcccactgattctacacgatggtgaattgtggaattatttcattatatatattacaatgtaataataatagaaataaagcacacaataaatgtaatgtgcttgaatcatcccgaaaccatcccaccctggtctgtgaaaaaattgtcttccatgaaaccagtccctggtgccaaaaacgttgaggaccactgctccacagaatctatcggtcactcttcctcccctcacccccttgccctaaaagcacaccctgcaaacctgccatgaattgacactctgtttctatcccttttccccttgtgtctgtgtctggaggaagaggataaaggacaagctgccccaagtcctagcgggcagctcgaggaagtgaaacttacacgttggtctcctgtttccttaccaagcttttaccatggtaacccctggtcccgttcagccaccaccaccccacccagcacacctccaacctcagccagacaaggttgttgacacaagagagccctcaggggcacagagagagtctggacacgtgggggagtcagccgtgtatcatcggaggcggccgggcacatggcagggatgagggaaagaccaagagtcctctgttgggcccaagtcctagacagacaaaacctagacaatcacgtggctggctgcatgccctgtggctgttgggctgggcccaggaggagggaggggcgctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggcttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacggactcccagagccagtgagtgggtggggctggaacatgagttcatctatttcctgcccacatctggtataaaaggaggcagtggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggtaggagaaaagcaaactccctccaacctcttacttcgggcttaaggcagagaactcgcctccccagaatctcctccctccatgatcccccgctattcctctattttcttttcctcggacctgcagccttgggtcgaccctgccctaggggtgactgcaggagagcagggaggatggtcaggcgtcaccaacaaccccatcacccagtaacaagaaccttgactctctcagtccctctgcatcaagacacttacccatttcccacctcatgcctgctaacttgaatgaaacaatcgctgggaaagcattaagagattaaggctgggcactgtggctcatgcctgtaatcccagcactttgtgaggctgaggcaggcagataacttgagcccaggagtttgagaccagcctgggcaacatggcaaaaccctgctctcccaaaaaaatacaaaaattagctgggcgtgctggtgtgcctgtattcccagctacttgggaggctgaggtgggaggattgcttcagctggggaggacggaggctgcagggagccaagactgagccattgcacccagcctgggtgacagagcaagaccctgtctctaaaaatgaatgaaaggaaggaagaaagagagagaaagagagagaggaaagaaggaaggaagtaaagaagaaagaaagaaagaaagaggaaagaggaagaaagaaagaaaagaaagaaaagaaaagaaagcaaatttaaagcttatgcaaatcaaagatgttgtgataattgataattgagtctgggctaaattccccctgggctgcaaaggcagagagtggtaatgactctcacctgcttttcttctaaggcttttttacgggacacagagggaagggagatggactggattccaagattcccacagggcaagatgggcgaagactccctgccactgcccggggataagtcagtctgagtgagacggagtgggatgggcttagaacctgaacatgtcatggtctcttcctgcaccttgccctagtgttcacttaccacctgcttgcaggaaacaagaagagcagggcccacagctggccagctcccctcccctcccgcctgtcttccagaacgattccttcaccagccctctttccattgctctaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatggtgagccacgggacaccaggggaggtgggtggcatgcagaacagacctaccagaagccaaggaaaggctggctctggcttagccgagccaagccccatacagctgtgctgcaggggccaccccatcttcttcccactacactccaagtcactggacccttgaatctccaagggtgtctgaccagtagatttaccgcttattcaccaccgtgtgatcttaacctcgttaagtttgcccatctacaaaatgaggattatttgctgtcctaaagaattcatgagccgggcgcggtggctcaaacgcctgtaatcccagcactttgggaggccaaggcgggcggatcatgaggtcaggagatcaagaccatcctggctaacacagtgaaactccatctctactaaaaatacaaaaaaaattagccaggcgtggtggcaggcgcctgtagtcccagctactcgggaggctgaggcaggagaatggcatgaacccaagaggcagagcttgcagtgagctgagatcgtgccactgcactccagcctgggcgacagagagagactccgtctcaaaaaaaaaaaataaagaattcatggaattacacttgtgaaatacttagcatagccatcactataggaaaaaaatctaaggccaggcacagtgcctcatgcctgtaatctcagcacttttggagtttgaggcaggaggatcacccaaggctaggagttcaaggccagcctgggcaatacggtgaaaccccgtctctaataaaaatataaaaattagtctgatgaggtggtgcacctgtaatcccagctactcaggaagctgagacacaagaatcactttaacccgggaggtggaggtggcagtgagctgagatcacaccattgcactccagcctaggtgacagagtgagacctgtcaaaaaaaaaaaaagaaagagagagagagagagaagagagagaaagaaagaagaagaaagaaagaaagagagagagagaaagaaagaaagaaagaaagaaagaaacaaagaaacaaagaaagaaaggaaaagaaaaaaaaaactaaggccaggcaaggtggcttatgactgtaatttcagcactttggaagattgaggcaggaggatcacttgaggccagaagttcgagacaagactgagcaacagggagacccctgcctctacaaaaaaatttacaaattagccagatgtggtgacacatacctgtagtcccaactactcaggaggctgaggtgggaggatggcttgagcccaggagctggaggctgcagtgagctatgattgtaccactgcacttcagcctgggcaacaaagggaagccctgtctgaaaaaaaaaaaaaaagaaaaagaagaagaaagaaaatatttgggttcaaccaggaggcgaggttgcagtaagctgacatcgcgccattgcactccagcctgggagacaagagcaaaactccaactcaaaaaaaaaaaaaaaaaaaaacaggaagaaaatatttagggttcataacttaagaacagagaaaaatattctagcccaaagaaagggttgggatctgagacttttgaagaaaggaaggagatacagaaaagagatttcatcctggaatgaaatctccctccagagagccctgggaaagcacggtagcccccatccatcagagtggagccccttgtgggggaagtgggctcggctgggaaccctcaattcagcataagcctcacatgtcctctcctctctgtcccggtgcagacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtgagcaggcagggaaaggaaacccatttcctgggcctcaagagaaagggaatttggaaataaatccacatatcccagttgggtgcagtagttcacacctgtaatcccagcccaacactttgggaggtctaggcgagaggaaggcttgaggcctggagtttgagaccagcctggccaacataacaagacctcatctcttcaaaaaatttaaaaaccagccgggcatggtggtgcacacctgtagtcccagctacttgggaggctgaggtgggaggatcacttgagtccagcagttcaaggctgcagtgagctatgtttgcaccaccacactccagcctgagtcacagaacaagacctcatctctaaaaaacaaacaaaaaccaaatccacatatcctaaaaaatgctccttttcagcattctcttctctatggacaaagggctggatgctttaagaaccaaatcttaggctgggcacggtggctcacgcctctaatcctagcactttgagaggccaaggcgggcagattgcctgagcacaggagttcgagaccagcctggccaacatggtgaaaccctgtttctgtcaaaaatacaaaaaattagccaggtgtgttggcgcgtgcctataatcccagctgctcgggaggatgaggttcaaagaatcacttgaacccgggaggcagaggctgcagtgagctgagatcatgccactgcactccagcctgggtgacagagcaagactttgtctccaaaaaaaggaactagacgggttcatttaaacccctgactgcagccctttgacatacatccaattgaggactggggactccgggaaacatctaaaaggcttaaaaactttgtctaacttcagccgggcatggtggctcacacctgtaatcccagcactttgggaggctgaggcaggtggatcacaaggtcaggagtttgagacgagcctgaccaacatggtgaaaccccgtctctactaaaaatacaaaaattagccaggcatggtggcaggcgcctgtaatcccagctattcgggaggctgaggcaggagaattgcttgaaccccggagacagaggttgcagcgagccgagatcgcgccactgcactccagcctggcaatagagtgagactccatctcaaaacaacaacaacaacaacaacaacaaaatcgtctaacttcctgatcttcctgatcattgattttcccataggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatagtaagtccaagagccccttccccacagcccacagcaactgcatctcattcctggggtctcccaaggaatacccaaaatgtcaccctctgagggaggaagaccacagggaatgctcccctttaagggaggagagaccctagaatatactccagctttgacaaagatttcccaagcaggagacatcaggataatgggaacagaagacaggaggtttatcccatgaaggatgaagaagctgaaatccagagattccctcagggccacatttgtccacctgactccagggtctcatcttcgtgtgttgctagtgtgattacctggggatgagaaatcctgctgggggagttgaggttaagaggatgaggactccaggtgctgtggctcacgcctgtaatcccagcactttgggaggccaaggcaggtggatcaggagtttgaggtcaggagtttgagaccagcctggccaacatggtgaaaccctgtctctactaaaaatgcaaaaattagccaggtgtggtggcaggcgcctgtaatcccagctactcgggaggctgaggcaggagaatcacttgagcccgggaggtggaggttgcagtgagccgaacgaaattgagccacttcaccccagcctgggcgaaagagtgaaattccattcaaaaaaaaaaggatgaggactgggatgaactggtggctgggtgtggggaaaatggaagtgaaggaaggccaaaagagacagagaaggcctggcgcggcgactcacgcctataatcccagcactttgggaggctgagaagggggattgcttgaggccagaagttgaataccagtctgggcagcatagcaagaccctgcctctacaaaaaaaaaattttttttaattagccaggcttggtgacatgcatctgtagtctactcaagaagctgaggtgaggccaggcatggtggctcacgcctgtattcccagcactttgggaggtcaaggcgggtggatgacctgaggtcaggagttcaagaccagcctggccaacatggtgaaaccccatctgtataaaaatacaaaaattagctgggcatgatagcaggtgcctgtaattccagctactcaggtggctgaggtgggagaatctattgaacccgggagggggaggttgcagtgagccgagatcatgccattgcactccagcctgggcgacagagtgagactccttctcaaaacaaacaaacaaacaaacaaaatacagaagctgaggcgggaggaacatttgaaccggattcggaggctgcagtgagctatgattgcaccactgcgctccagtctgtgtgacagtgagaccctgtctcttacacacacacacacacacacacacacgcacacacacagagagaaattagaagatactgaattggcagaagagaagggaaatagaaattaaaatactgaataggggagcagtgaacaggggatacccaaaagccaagagcgagagagagcctggcttccagaaatagtggagaagccaggagaactaggtgaaaacccagtgctgggttgccatcagcaagagctggagccatttccaacgaaccatcttgtcgtcttcacagctgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagtaagccaccccgctatctccccgacctaccaacccctctctcctggctccctaaagtcaccgcccccaggttgaatttcccagatctgtgacgcttgcaggacatgcatgtgtgggaggctgatgggaaactgtggcctgggtttgattatgagtcttgcaatcatccctccccctgtttctgctggagggcaggggacagctcttcctgaccacacccccacattgactatccccagaatacccagcaaaagcccccaaaaggagagtcagagaaatgagggaggtgggggcccaatcagtccacatctacttagggtcgccccatcagcacttccatccccaaccctttcaagtcaacatccaaacaaaagaaatcacttccaaggacggagcagctcaaagcgcagctctagctggggttccaagaaagcagatttttcgaaatccttctgcagaaggaagcaaagagattttttgaaatctttctgcagaaggagaaggctggagctggggaactccagaattatagggaagcctcccaccacgctcatcccaaatttccggatgctataatgccaggcttggggaaagaggagaatttagttggttagctggtgcgtgctctcacttgcatcctctctcttcctcttttttttttttctcctctctctctggctcataaaaatggaggtaattagttgtgccctggtgagaagcagagagtgcacaaaggccccctgcttgagtcctcttcagggttagctctcagaaacacaatctgcagaacagatttttgttccaacatccttgcaggagaatttgcccttagcttcccccaccccagccaggctgaataaaattatgctgaaactactgtcttatttgaggaaagtaattagtcataggtgggagggggtggggagattgcagaagaatgttcatgaatattaggattttcagctctaaggggggactttgtaaacagctttagaagaagaaccaggccggctgggtgtggtggctcatgcctgtaatctcagcatttggggaggccaaggcgggcggatcacttgaggtcaggagtttgagaccagcctggccaacatggtgaaaccctgtctctattaaaaatacaaaaattagccggctgtggtagcgagcgcctatgatcccagctactccggaggctgaggccagagaatcacatgaacctgggaggtggaggctgcagtgagccgagatcacgccactgcactccagcctgggggacagagcaagaatctgtttcaaaaaaaaaaaaagaaaaataggaaggaaggaaggaaaggaaaggaaagaagagagagagaaagaaagagagagaaagaaagaaagaaagaaagaaagaaagaaagaaagaaagaaagaaagaaagaaagaaaaagaaaggaaagaaagaacgaacgaaccaggcctccctctccaaccttcacctccgtccctattctggccacttgattcgggggacacctggtaggggatggggaaaggtgggagctgccagccagagggggaccccggcttgagcagcctcttgctgctatctgcaggttctccctggagactgaagtcgacctcaggaagcccctagagaacctgggaatgaccgacatgttcagacagtttcaggctgacttcacgagtctttcaggtaagaagactttcctttgcattttctcaccccagtggactgcgggggcccctaagaggaaaaaggaacctctccttgagagcggcagcgatctaatcctgtatccacatctgtttcagaccaagagcctctccacgtcgcgcaggcgctgcagaaagtgaagatcgaggtgaacgagagtggcacggtggcctcctcatccacaggtgagtctggctcaggtgaggctccacgggtgtcgcctccatcgcccttcaggataactggtccccagacccggaaaggaccccgcagccctctcggcacagagcagctctgtctgtgctcagccatcacccactccccacctgtttctcagcctggaaaacgggcttgggaccatggaaccctgtttcctcgcctgatggctcctaagttccctgactgtgaaaaggcctcctaaagaaaaacccaagttgttcccacagtgggaagtaaacttaagaaacatgcttatcaggctgggcatggtggctcccacctgtaatcccagcgctttgggggaccaaggcaggtgaatcacttgaggtcaggaattcgagaccagcctgggcaacatggcaaaaccctatctctactaaaaatacaaaaattaggcaggcgtggtggcatgtgcctgtagtcccagctacttgggaggctgaggcaggagaatcacttgaatccaggaggcagaggttgcagtgagccgagatcacgctgctgcactccagcctgggcaatagagcatgactctgaagaaaagaaagaaagaaagagagagagagagaaaagaaagaaagaaagaaagaaagaaagaaagaaagaaagaaagaaagaaagaaagaaagacaaagaaagagaaagaaagagaagaaaagaaaagaaagagcttatcaataagcccttaaaggatttagataaatgtgtgtaagggaagagctgatccattgctaccaagctcctggaggaaaccaggtctcagaggatgtccctaaacttttaaggttcatattcaggaaaacaaacaacttccagctgggcttagtggctcactcctgtaatcccagcactttgggaggccgaggcaggaggatcgcttgagcccaggaatttgagaccagcctgggcaatataatgagactgtgtctctacaaaaattagaaaaaaattagccaggcatggtggcatgcacctgtagccccagttacttgggagactgaggtgggaggatcacttgagcccatgagttcaaggctgcagtgagccatgaaggtgccactgcactcccgcctggcgacagagggagaccctgtctctaagaaaaacggcgggggtgggggtggtgccagtgccagcatccctctgttctaagacattgtcccttctcttgcagctgtcatagtctcagcccgcatggcccccgaggagatcatcatggacagacccttcctctttgtggtccggcacaaccccacaggtgagcctggaacccatcacgttccacatcctcccacccattctttctctcaggaactagtcccgacagatgcagacatccctctatccctgagagggctctgggcagggaacccataaccctaccctgcttcctgtcccaagaggaggctaccttctatcacccacagacagtgccgggtccccgctctgtgactcaggcagctgcgactccagacagctcactcatctgcctagatctcagtccttccacccacatccagcctgatgagctgtcccactccttctgcttctcaacccccatggttcttccaccctcaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggacggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaaccaccaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactgccttcaccttctccatttcacaccggtggtacaagaaatcagaagcctaggccaggtgtggtggttcatgcctgtaatcccagcactttgggaagccgaggtgggtggatcacctaaggtcaggagtttgagaccagcctggacaacatggtgaaaccccgtctctactaaaaatacaaaaattagccgggcgcggtggctggcgcctgtaatcccagctactcgggaggctgaggcaggagaatcacttgaagccaggaggcagaggttgcagtgagctgagattgcaccactgaactccaggctgggtggcagagcgagactccctctcaaaaaacaacaactacaaagacaacaacaaacccagaatcaaaatcctgttggtccatagacctcatgggtggaagagaccttcctacatccaggttggcccaacatgggggagtccatgaaatggtcacctcagctctgccacaagccccaaggataagttgattctgcccctgggaatcatcctcaaaaaggaaaaaaatgttcccctgccataaactttccacttatgcagatgggcctgctcgtaagtcactgtcactgtgggttcccaactctgttcatgacacttccttccagcaccaaatgcttcccacccctctactcccactccccattcttcaaacccagctcaagttccagttcctccacctaggacttcccatggatccggccaatatcactctcaggtccagcgcagtggcccacgcctgtaatctcagcactttgggaggccggggcaggaagattgcttgaggccaggagtttcagaccagcctggacaacatagtgagactcttcctctaagaaaagaaagagagaaagagagagagaaagacagaggaaagagagagaaaaataaagaaagagaaagagagaaagaaagaaagaaaaagaaaaagaacgaaagaaagaaagaaagagaaagaaagaaagaaagaaaaagaaaggaaggaaggaaggaaagaaaggagggagggagggagggaaggaaggaaggaaggaaggaaggggatcaaaacatcatcactctcaactcgacactgactgagttttcttctccctggtctgtaacagtgcttggattctcgagtgttctttagctttgtgtgtgtgtgtcttaccctccccaagcccatcaaggtatcaggtttcttgaaaacaaggctctcttgttatatatactctagcatcttcttgaaaatggcttcctgaaaagtcttttattatctttctccagcatctcgaaggcttttggcagagggcacacttccctccattagtttctgttcaaatattcaaaaataattttttaaactgaaaaaagaccaataaccatctgttgaacttgtatactgtctaactccagaaccctgaagataggattcagagatgcagccccctgaacacccgactcatttctattgctttttaaacaattttttgtagaacggggttgcaccatgttttgaacttttgggctcaaacaatcctcctgcctcggcctcccaaattgctgggattacagttgtgagccaccatgcccagcttggctcaggtgtacctttcaacctccttataccctgaaagtatgactaattcaggcccaggctagtggctgaaaagttacctgtctctaacagatttgcttggaaagctaaacagcctctttttgcacaaaatgcttcaaaaagcagaacaaattagccctaactctgcagtatacagttcaaaaactgctcatccatgctgagatggctctagaggaaaaagagtccttcaaaaagcccccttaccacagaggaggcttgttccaggaaatccccaatttacaagctctcaagctattgtgaggcaaaaaatgatgtagactcagcaagcacgagacctgcccagccctgtttagctttgcctagccctgtcccttgcctgttctaagtttgtcttcccttctctatttttttttttcttttaagacagggtctcgctttgttgctgaggcaaaagtgcagtagcacaatcttagcttattacagcctccatctcctaggcccaaagccatcctcgcacctcagcctcccgagtagctgggaccacaggtgtgcgccgccaagccctgctaatattt

SEQ ID NO: 2098 - DNA, 1529 bp, Homo sapiens
  Genbank Accession No. J03805
ggacgacaaggcgttcaccaaggagctggaccagtgggtcgagcagctgaacgactgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgttctgtaacaaattgggatctgtcttggcattaaaccacatgatggaccaaatgtgccatactaatgatgagcatttagcacaatttgagactgaaatttagtacactatgttcatggtcagcttaacagtttgctggtgatttatagtaacattttctttgactgtcaagcaaaaggtaactaactgcttcatctccttttgcgcttattggaaattttagttatagtgtttactggcatggattaatagagttggagttttatttttaagaaaaattcacaagctaagttccactaatccattatcctttattttattgaaatgtataattaacttaactgaacaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaactttcgtttaaac

SEQ ID NO: 2099 - DNA, 3168 bp, Homo sapiens
  Genbank Accession No. J03810
cacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttc

SEQ ID NO: 2100 - DNA, 1481 bp, Homo sapiens
  Genbank Accession No. J03827
ccgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgaggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtacttgctttttgccgtttgcaaccagataaatagaactatctgcattatctatgcagcatggggtttatattttactaagacgctctttggtatacaacggttttaaaagcctggttttctcaatacgccttaaaggttttaaattgtttcatatctggtcaagttgagatttttaagaacttcatttttaatttgtaataaaagtttacaacttgattttttcaaaaaagtcaacaaactgcaagcacctgttaataaaggtcttaaataat

SEQ ID NO: 2101 - DNA, 1922 bp, Homo sapiens
  Genbank Accession No. J03910
gagacctgggcgttggtgaaggcgaggggaaagccagaatactggggtggcggacgccaaggggcgggtgtagcaggcaacctcagggaagctgggaaggcctagcagggtgagagaacccgcacacggggggcacagcgcctccctcgcgagccggtgcgaaaggggccgcctgcggtgtgcgcccagctgcgctcaagggaccttgcacttggcccatctcctgcgcacagcccaggccgggaccgcgggcggtgcggactcagcgggctgggtgcaagggcggggcggggcgtctgcgcccggccccgtctcctgactataaaagcagccgctggctgttgggctccactccgccttccacgtgcacccactgcctcttcccttctcgcttgggaactctagtctcgcctcgggttgcaatggaccccaactgctcctgtgccgctggtaagggacgcccgggttctgtgccttggaatgccaaattcccagacaccatagagagtgtccctgggtttgaggaggtcgtattttgctatcagaggtaaggggactcctttattggtccagtgctttcctgttggccaagctcctgagggcattttcctcctccctgttcctctatgtcagagttgagggtcctgaggctcaaggctgtcctgctcatgtcagagttgagggtcctgaggctcaaggctgtcctgcctcacgtcacctagttggtcacagggctgctggctgagccccaattctctaacctgactctgagctaccggattggataggagacattggataggagggacattgcctcttccaagttcaggacagaaagtcgaagtcttcctaggccgtgatctgcagggactttcctttggagtagaaataggagggtgcttggttttcccagcatgaatggagaggacatggggcttctcttcctcgtctctgagtgggaaaggagctctgacggctggctctggcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcctgcttctggggaaccggccttcctttgtccctgtaggttgtcacgcctgtctagtcttctgcactttccaaggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctatgatcgagtctgctctgacctctcaatctcctttcctccccaaggctgctgctcctgctgccctgtgggctgtgccaagtgtgcccaaggctgcatctgcaaaggggcatcggagaagtgcagctgctgcgcctgatgtcgggacagccctgctcccaagtacaaatagagtgacccgtaaaatctaggattttttgttttttgctacaatcttgacccctttgctacattcccttttttctgtgaaatatgtgaataataattaaacacttagacttgattcccgttctggttcctgttgtgtttttggaatgagggactggggtgggagattgaactgggagttcacactgggctctggacggaaatgtgagtgctaaacaagctgagcgccttcaggcagccccgttacttctctgacctccttcctctgtaaaaggcacctgcaccgtgccggatgatatggggatggggacatacgcg

SEQ ID NO: 2102 - DNA, 2038 bp, Homo sapiens
  Genbank Accession No. J04029
caccatgtctgtccgctactccagcagcagcaagcagttctcttcctcccgcagtggaggaggaggtggcggagggtcctccctaagaatatctagctccaaaggctccctcggcggaggatttagctcaggggggttcagcggcggctcttttagccgcgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggcttcggtggaggcggctttggaggaggctttggtggtggattcggaggagacggcggccttctctctggaaatgaaaaagtaaccatgcagaatctgaatgaccgcttggcctcctacctggacaaagttcgggctctggaagaatcaaactatgagctggaaggcaaaatcaaggagcggtatgaccagcatggcaactcacgtcagggggagcctcgtgactacagcaaatactacaaaaccatcgatgaccttaaaaatcagattctcaacctaacaacagataatgccaacatcctgcttcagatcgacaatgcaaggctggcagctgatgacttcaggctgaagtatgagaatgaggtagctctgcgccagagcgtggaggctgacatcaacggcctgcgtagggtgctggatgagctgaccctgacccaggccgacctagagatgcaaattgagagcctgactgaagagctggcctatctgaagaagaaccgcgaggaggaaatgaaacaccttcgaaatgtgtccaccggtgatgtgaatgtggaaatgaatgctgccccgggtgttgatctgactcaacttctgaataacatgagaaaccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaagagattcgagctgaaaccgagtgccagaatactgaataccaacaactcacggatattaagatccgactggagaatgaaattcaaacctaccgcagcctgctagaaggagagggaagctccggaggcggcggacgcggcggcggaagtttcggcggcggctacggaggcggaagctccggcggcggaagctccggcggcggctacgggggcggaagctccagcggcggccacggcggcagttccagcggcggctacggtggtggcagtttcggcggcggcggcggcggctacgggggcggcagctccggcggcggcagcagctccggcggcggatacggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctacggttgaatcagaaaccaagaaacactactattaaactgcatgaatctcccttcacacagaccattatttacagatgcatggaaaacaaagtctccaagaaaacacttctgtcttgatggtctatggaaatagaccttgaaaataaggtgtctacaaggtgttttgtggtttccgtatttcttcttttcactttaccagaaagtgttctttaatggaaagaaaaacaactttctgttctcatttactaatgaatttcaataaactttcttactgatgcaaact

SEQ ID NO: 2103 - DNA, 3112 bp, Homo sapiens
  Genbank Accession No. J04031
gtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggagacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccctgaaacagaacaggtgaatggattattctaaacagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgcca

SEQ ID NO: 2104 - DNA, 1209 bp, Homo sapiens
  Genbank Accession No. J04056
cagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 2105 - DNA, 2647 bp, Homo sapiens
  Genbank Accession No. J04080
gggccggagttcctgcagagggagcgtcaaggccctgtgctgctgtccctgggggccagaggggttgcccagcatgcccactggcaggagagagggaactgacccacttgctcctaccagcttctgaaggctccaaagtccggagtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagc

SEQ ID NO: 2106 - DNA, 2422 bp, Homo sapiens
  Genbank Accession No. J04093
taaagtaacaacggtaataaagagttttcactctccaaatcacagggctcctaggtattttccctaaactaaccactgctttccaggatggcctgcctccttcgctcatttcagagaatttctgcaggggttttcttcttagctctttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatacaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgagaaactcgcatcagctgtcctcaagagagatgtggatataatcaccttatcagaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaaaccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtccttatggctacccgaaatgcttggggaaaaaagggcgagttaagaaagcccacaaatccaagacccattgagaggtgggtgggaaataaggtaaaattttgaaccatccctagtcatttccaaacttgaaaacagaatcagtgttaaattcattttattcttattaaggaaatactttgcataaattaatcagccccagagtgtctttaaaaaattctcttaaataaaaataatagactcgctagtcagtaaagatatttgaatatgtatcgtgccccctccggagtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcattgatccttaaccaataatggtcagtcctcatctctgtcctgacttcataggtgccaccttgtggtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttacttttttttctgatgtttcctacaactaaaaataaattaataaatttatataattct

SEQ ID NO: 2107 - DNA, 2259 bp, Homo sapiens
  Genbank Accession No. J04152
gttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgccgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgacctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgaagtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcacagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactaccactgatattggtaatgttcttttttgtaaaatgtttgtacatatgttgtctttgataatgttgctgtaattttttaaaataaaacacgaatttaataaaatatgggaaaggcacaaaccagaagttggcatttgtgaaaagtccctccagatttctatcactttggtctctaatttcccaagacttgtattttttttttatttcaaattataacacttttttttcccccagaagtgggtgtttcatgttgctactctggtgtgtcccaagatatcctaactggccagtgtaaatgctattctttctaaataagattatttggaaacttccttcaaactgcag

SEQ ID NO: 2108 - DNA, 853 bp, Homo sapiens
  Genbank Accession No. J04164
ctagtcctgacttcacttctgatgaggaagcctctctccttagccttcagcctttcctcccaccctgccataagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgtcactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 2109 - DNA, 5793 bp, Homo sapiens
  Genbank Accession No. J04423
atactaacttgagcgaaacgggaaggtaaaaagacaaaaagttgtttttaatacctttaagtgataccagatggcattgcgccatctggcagagtgattaactaaacatcgcagtaatcgaggcgcttgccagagagtggaaatgaacgttaaacccgaccatcgccgcgctggcaccttcatcgacatcaatacgttctatatccagcgcgtgaacggtaaaaatgtagcgatgagtttcgcctttcggcggtgctgcgccatcgtacccggttttaccaaagtcggtacgcgtctgcaaaacgccgtctggcattgctaccagaccagagccaaacccttgcggtaatacgcgggtatcagcgggtaagttaacaactacccagtgccaccagccggagccggttggcgcatccgggtcgtagcaggtgacaacaaaacttttcgttcccgcaggaacatcatcccacgccagatgcggtgaaatattatcgccatcgtaacccatgccgttaaagacatgacgatgcggcaatttatcgccatcgcgcagatcgttactgatgagtttcatgaaccctcctttcttgtttgcagaaagtgtagccagaaaccctcacgcggacttctcgttattggcaaaaaaatgtttcatcctgtaccgcgcggttaaccgctgcggtcagacgctgcaactgttgcgggagaataatatagggcggcatcaggtaaatcagtttgccaaaaggccggatccagacaccctgttcgacaaagaatttttgcagcgccgccatattcaccggatgagtggtttcgaccacgccaatggcccccagtacgcgcacatcggcaaccatttcggcatcacgggcgggggcaagttgctcgcgcagctgtacttcaatatccgccacctgttgctgccagtcgccagattcgagaatcgccaggctggcgtttgctgccgcgcaggccagcggattgcccataaaagttggcccatgcataaagcaaccggcttcaccgttactgatggtttctgcaacctcgcgcgtggtgagtgtggcggaaagggtcattgtgccgccggttaaggctttaccgaggcacaaaatgtccggcgcgatttctgcatgttcacaggcaaacagtttcccggtacgaccaaatccagtggcgatctcgtcggcaatcagcaagataccttcgcgatcgcatattttgcggattcgttttaaccattccggatggtacatgcgcatcccgcctgcgccctggacaatcggctcaatgatcaccgccgcgatttcatgacgatgcgccgccatcaggcgggcaaagcccaccatatcgcgctcatcccattcgccatccatgcggctttgcggggcgggagcaaacaggttttctggcaggtagcctttccacagactgtgcattgagttatccggatcgcacaccgacatcgcgccaaaggtatcgccatgataaccattgcggaaggtcagaaaacgctggcgcgcttcgcctttggcttgccagtactgcaacgccattttcatcgccacttccaccgctacggaaccggagtccgcgagaaaaacgcactccagcgcgttgcggccgctcatcgccaccagtttgcggcacagctcaatggctggcgcatgggtgataccgccaaacatcacatgcgacatggcatcaatttgcgacttcatcgccgcattaagctgcgggtgattgtagccgtggatcgccgcccaccaggacgacataccgtcaaccaggcgtctgccgtcagacaaaatcagctcgcaaccttcggcgctcaccaccggataaaccggcagaggggaggtcatggatgtgtatgggtgccagatatggcgttggtcaaaggcaagatcgtccgttgtcataatcgacttgtaaaccaaattgaaaagatttaggtttacaagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaacgtcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaacgtcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaaacgttattttgtcaccggaacggataccgaagtggggaaaactgtcgccagttgtgcacttttacaagccgcaaagcgagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcacaggtaatacaacacgccggactgactctggcgggttgggtggcgaacgatgttacgcctccgggaaaacgtcacgctgaatatatgaccacgctcacccgcatgattccgcgccgctgctgggagagatcccctggcttgcagaaaatccagaaaatgcggcaaccggaaagtacataaaccttgccttgttgtagccattctgtatttggttaaattgcgagcgagatcgcgtcttcgattgactgcaatttaaccaattaaattctaaaataatcacgaaaaaaattttacttccgcctcatgcggcgaatgtgggaattgcccaggcggcgggggataggggctggagacagttatccactattcctgggat

SEQ ID NO: 2110 - DNA, 2849 bp, Homo sapiens
  Genbank Accession No. J04449
gcacagcaaagagcaacacagagctgaaagcaagactcagagcagagagataagtaaggaaagtagtgatggctgtcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtgcggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataatctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaagggtgggtggtgatgattccaagctatgctcttcaccgtgacccaaagtactggacagagcctgagaagttcctccctgaaagattcagcaagaagaacaaggacaacatagatccttacacatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccgagtctagcaccattaactcctcctgagcttgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaccaacaagtaaatatttttggtcattgtaatcactgttggcgtggggctttgtcagaactagaatttgattattaacataggtgaaagttaatccactgtgactttgcccattgtttagaaagaatattcatagtttaattatgccttttttgatcaggcacagtggctcagcctgtaaccctagcagttttggaggctgacgcgtttaggaccggcctgaggtcaggtagccttcaaggacaaggcctcggcctacatggttggaaaggccccatgctctactaaaaatacactaaatttagctaggccatggtggactcgcctgtaatctcactacacaggaggctgaggcaggtcagtagagtccatcttgaacctgggtaggcggatcgttggaacgttgcatgctgtagtattgcaccgactgcagctgccgagtcgtgggtgagagtgagagcgtgcagtcttaaaaaaactattgcctttttggaggcacggtacattttgtaaacaaagcaaggctgaagtcgtgcttgacttatatctattagttttgatttaattggttttctacagccccaattccttgccttttccaattaattttccttggggaaggaaccaaggaaaaaccaattggttttccccttaaccaacccttccttttggccaattttcccatccctaacacccaactgtctcgatgcaatgaacacttaataaaaaacagtcgattggtcaattgattgagcaataagcct

SEQ ID NO: 2111 - DNA, 6896 bp, Homo sapiens
  Genbank Accession No. J04469
catgccacatccccggggcgggagggggctacatccccggctttagacgcgcgagtctcaggtcccgctaattacctggcgggtgctgcccacccctgccctcgcgcacctagcgcgtggcagcgggaaggcggggcctgggggagccccacccctggagactgcggctggggcctccctctcctccgcccgcccgcctgccactagctcattgcgcctctcctgcagtctgattgggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtaacagtgcctgaggcgcgggaggaggcgggggcaggaggtgatgggaacgaaggtgcgggtagaagtgagaatccgggcaacagagaagggctataatcacgaaggccctggagctggagggctgtgcagtctgcagacctcagtggggtgggggtgggggccaaaaccataaagcaagaacattcctggggacctgccaagaccagctctggccctacgagttctagctgcactggctgcccaaatccctaattgtaaagccaggaactatccttttcgctcccctccatctccttccctcatttcctcaattcctctccttaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattcccctcctcccgcggagcaaagccagacatggccaactggacagctcccaggtaactgcactaggtctaggcgtctgtgaccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtagggggtccccagagtctccctgatgatccaattcatcttcccagtaatcccagctcctttcccttaaagacctctcactttcccccaagactctgagccccccatacttaagttttctgaaccagtgaaatcaatgcacaattgaagtctggggagggattccctctccttaaccatctctccctcttaactccccttaggtatttgctgacctgtttgaccctgtgatccaagagcgacacaatggatatgacccccggacaatgaagcacaccacggatctagatgccagtaaagtgagttcaaatatcccacttctgatttgcattgcctgtgtacaacactctgtatctccaaccccttcaccttatttcctgactcatggtcattatactgctgagcttttaatcttaatgtaaggaaagaatcatatcttaaggggcagcatatatggagatggaaggatagataagaatgaccatgacccaaggtgggtggtttggggacgggtctgcaatgcccccttcaattccagtgctttcccaaagggcctcttcttccaatgcatgcaggaagaatgcacacagagtcctctaatgcctaaggaaggtctctcctttcccaggggccctcagttcccaccgtgtttctgtgacttacattcatttcccttatctcccagatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgtgagggccttaagagggtgctggttggtgggagcagatggggaaggctgggccagatgagacatgggctctgaaaggcccaggggccaccatgaagattcttaacccaagtcccgttactcttcccaggaccactttctgtttgataagcctgtgtccccgttgctgactgcagcaggaatggctcgagactggccagatgctcgtggaatttggtatgaagctgctcattacctcttttgtcttcatgccctcataaatgctttttttccctctatctctcccaattcttgccttgcctcttgatcactgtccctctccggccctcaggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggcttttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtttcgggtctaggctttaagttgagagttcggagagagactggggaaggtggaggatagaatggttcgagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcatgtaagatatcccctatggcatggttccttctgaactataaagaggatccctttactcatgttgggttgtggtctttgtgaccatcattctgctagatcccttgtctcttgaactctaatagtcatcttcatgactacatggttaagtgaagccaaacgccttccccccgccccctattcctatgaatctggcttttctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagtaaaggagttgtggggttacagaggggtgtgagtaaggaagggtgggttgtggatggggagggagtggaccctttggaaaggagccaaacatgttgtggctaaagggtcagaggacaggccaggcacagtggctcatgcctctaatcccaacacttgggaggccaaggcaggcagattacttgagcccaggagttcaagaccagcctgggcaacctggtgaaaccccatctctacctacaaatacaaaagttagctgggtgtagtggaggctgaggtgagaggatcacttaagcctgggaagtcgaggcttcagtgagctgtgatcactccagcctgggtgacagagagagaccctgtctaaaaaaaattaaaaaagaaaaaagaaaaaaggaaaaaaaaagttcaggagacagagctctgagcaggttcagggctctttcaggtaggacctagtctctgcctctattgaccctgctcccaatccctatctcctctctaggatagccgcttcccaaagatcctggagaacctaagactccaaaaacgtggtactggaggagtggacactgctgctacaggcggtgtctttgatatttctaatttggaccgactaggcaaatcagaggtgagatcctaagggattaggacaaggagaggtataggtctgcgagggccgaaatatggcagtgagtgagcctccgggatgtaacataatctgaaatgaaattcaggttgagtgggaggcaattggaaatgagcaggcaagtcagtcagtgataaagaaaaactcagactgtaggaagcagatcaaagattagtgtcccttaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttttgctcattctaatgatggcccattctacttgctctggacctgcccccgcatcccctgcctccatcctagtaaagactccttgctatgctgcagctgtctgtgttacttctaatggtggggtgaggagggagcagccttcaggaaatgaaaagaggcagtgggattatttatgatggaaagagactccagatatggcaacccaggaacactgattctcaggtgggtggaaagcattaacattttacccatattcctcatcagcttctgaaaataatcaggatgcacttctgtttgcactttattcattatgacttaagatttctctccccacaatctccttctactgtagagacaggctcatagcaggtggccaaggaagctgatagtcaataccagggaccaggaaggtcgtgaccagtcctggaggccccaggctgtacttcgacctataatagacagggaatgggagtaatatcacaactcagctctccaggagcattgatacttggaaattagcgctctgcctgtagactccttcactccagggatctccctgggtgcactctaagagccagacagcaccaaattaggggtttgattctgggtcaggagatggaggatcaagctgtgcagctgggaactcaccttgctgttctgggctctcctttccctcatgttgggcccatgcaactgctcgtcgctgctcaggactcagaaaggccatttgctcaggagtgacagccacagcctgagcactggtgagactagatagttggatgggactaaacaccacctgagggcaggggtaggaatcagtgcatgcatgtagtccccattgggccctggctctcctgtggtcaccccagtccattaatacttacagcaaatttaggaggagggatgacagaaatggcaagaggagtaacgccctggatctgtccccgcagcagtgctgaaagagccaggtctgggatcccagctgttgaagcaagtggcatccaaacattgtcttagactgaccttccctctcttcaaacctatagaccttctctaactactcccaaagtgccctatcatagaccttccccaatatgtctctagccccttatttaaacaccctcaggcccccaccttaagaattgcagggcagtcttccatccagtccacccatggtatagaaaccaaaccaacttgcaccagcagtggcccagctccccacctgctatggtgccaatttcagtgaagatctcaggcccccagttactgattgggccaaacccaccaggcagtacaagtaggtgggccagaacctccagttgttcctcagagcactgcagatgcagggtgccgaggaagagagctgcttggctgtagaacagtgggaaggaaggaagaa

SEQ ID NO: 2112 - DNA, 1326 bp, Homo sapiens
  Genbank Accession No. J04615
gagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacccgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 2113 - DNA, 3414 bp, Homo sapiens
  Genbank Accession No. J04621
ggcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacaactcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaaggaccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaggttgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaccaccctaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttcttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagt

SEQ ID NO: 2114 - DNA, 1707 bp, Homo sapiens
  Genbank Accession No. J04813
gggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggacttctactttggtcttcaagaaagctgtgccccagaacaccagagatttcaacttagtcaataaaaccttgaaataaagatgggcttaatctaatgta

SEQ ID NO: 2115 - DNA, 472 bp, Homo sapiens
  Genbank Accession No. J04823
ggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaatctatttaaacttt

SEQ ID NO: 2116 - DNA, 1393 bp, Homo sapiens
  Genbank Accession No. J05037
ccttctcttcgtgggctatctactcagttgatccctccctcgctggcttggctctgactcctgctcagacccatcacctttgccggggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtagtgcccggcaccacacctgctctcaccattgagcgcctcaagaatgaaggtgccacatgcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggagtgtggctggggggacgtgcctgtcatcgccatggagacttttggtgcccacagcttccacgctgccaccaccgcaggcaaacttgtctccctgcccaagatcaccagtgttgccaaggccctgggcgtgaagactgtggggtctcaggccctgaagctgtttcaggaacaccccattttctctgaagttatctcggaccaggaggctgtggccgccattgagaagttcgtggatgatgagaagatcctggtggagcccgcctggggcgcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagtttatccagcgcctcgtcgtatgtttggctgagcacctgtggccctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgagg

SEQ ID NO: 2117 - DNA, 2862 bp, Homo sapiens
  Genbank Accession No. J05158
cagccgatggggtgcgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcgacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgaccttcctgagcttgcagtggaacatgcttcgggtcctgcctgccggcctctttgcccacaccccatgcctggttggcctgtctctgacccataaccagctggagactgtcactgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggaggcatcttcgacaccaactacaacctgttcaacctggccctgcacggtaacccctggcagtgcgactgcacctggcctacctcttcaactggctgcagcagtacaccgatcggctcctgaacatccagacctactgcgctgccctgcctacctcaaaggccaggtggtgcacgccttgaatgagaagcagctggtgtccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcggcagggctccctgggactgcagtacaatgctagtcaggagtgggacctgaggcgagctgcggttctctgcggctcaccatgtctatcgaggctcgggcagcagggccctagtagcagccatacaggagctggggaagggggcctctggggctgaccaggcgacaggtaggggcgaggggagctgagtctccgaagccttgcttttcacatgcaagggacagggttacatccccaaggtgagggggtggagtctggtctgctccactaaccagggtctcctcctcctcttccttcatcgcttctcctggagtgtgcgcctaataaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatactaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctcttattttttaatcttgcccaaattcctacctaaggggtctagggagtcgcgccttacaaatcataaattttcatcagatgggttttataagaccctgtatatcatgacttatttttaatctgactatggcataacattacaagacgaggcaaaaatattgaacccccaaatatatttcctggccctaccttgaactggccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacgatcctttatcttaacctgaacattcctttccattgatcccaggtcttcagctgagctgaaccaattgtcaaccagaaaatgtttgaatttacctacagcctggaagcacccacccccgctgcttcgagttgtcctgcctttctgaactcaaccaatgtatttcttaaatgtatttgattgatgcctcagtcctccctaaaatgtataaaaccaagctgtacctcgaccaccttgggcacatgttcccaggccctcctgaggtctgtgtcacgggccatggccgctcatatttggctcagaataaatctcttcaaaaacccc

SEQ ID NO: 2118 - DNA, 1738 bp, Homo sapiens
  Genbank Accession No. J05257
cgggggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacacccctt

SEQ ID NO: 2119 - DNA, 2858 bp, Homo sapiens
  Genbank Accession No. J05272
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcgcccgccctgagctgcggcctccgcatggagggccactcactccaccaccgctgcagggaggcggacggcgctgttccggagcccggagcccggcaacacccgggacacgagacggcggcgcagggctacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagccatggcggactacctgatcagcggcggcaccggctacgtgcccgaggatgggctcaccgcgcagcagctcttcgccagcgccgacgacctcacctacaacgacttcctgattctcccaggattcatagacttcatagctgatgaggtggacctgacctcagccctgacccggaagatcacgctgaagacgccactcatctcctcccccatggacactgtgacagaggctgacatggccattgccatggctctgatgggaggtattgggttcattcaccacaactgcaccccagagttccaggccaatgaagtacgcaaggtcaagaactttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaatcgagactaccctctggcctccaaggattcccagaagcagctgctctgtggggcagctgtgggcacccgtgaggatgacaaataccgtctggacctgctgacccaggcgggggtcgacgtcatagtcttccactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatcccatggagaagagcagcagcagccagaaacgatacttcagcgagggggataaagtgaagatcgcacagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcgccccagattgagggtggtgtccatggcctgcactcttacgaaaagcggctgtactgaggacagcggtggaggccgaggtggtggaggggatgcaccccagtgtccacttttgggcacaggctccctccataactgagtggtccacagatttgcactacgggttctccagctcctttccaggcagagaggaggggaggtcctgaggggactgctgcccctcactcggcatcccctgcagagtcaggactgctcccgggggccaggctgccctgggaggccccctccgagaccagccagccaggctctcaggacctgcgctgccttaggatctttcttgctgcagcctgctccagcctggcccccaccccaggggcaggcggcccctcctggcttctcctgtagggcacctccctgcccctagcctcccagcaaatggtgctctcctggccctgctctggcccttcccgggccgtgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggt

SEQ ID NO: 2120 - DNA, 1855 bp, Homo sapiens
  Genbank Accession No. J05428
tgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacgttatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtataagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctt

SEQ ID NO: 2121 - DNA, 4139 bp, Homo sapiens
  Genbank Accession No. J05582
ccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagctcggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaacggtggcagcagcctctcttacacaaacccagcagtggcagccgcttctgccaacttgtagggcacgtcgccgctgagctgagtggccagccagtgccattccactccactcaggttcttcaggccagagcccctgcaccctgtttgggctggtgagctgggagttcaggtgggctgctcacagcctccttcagaggccccaccaatttctcggacacttctcagtgtgtggaagctcatgtgggcccctgaggctcatgcctgggaagtgttgtgggggctcccaggaggactggcccagagagccctgagatagcggggatcctgaactggactgaataaaacgtggtctcccactg

SEQ ID NO: 2122 - DNA, 1544 bp, Homo sapiens
  Genbank Accession No. J05614
gaattctgctgaccaaggtattaaaagtaactaaagagaagtggtgtgaagaaagcaagagagaaacaacaaatcctgtccatcctgtaacaattgaaaatttctggctgggcgtggtggctcacgcctgtaatcccagcactttgagaggccgaggcaggtggatcacctcaggtcaggtgttcaagaccagcctggccaacatggtgaaaccccgtctctactaaaaaaaaataataataataatacaaaaattagccgggggtggtggtaggcacctgtaatcccagatactcgggaggctgaggcaggagactcacttgaacctgggaggcggaggttgcaatgagctgagatcgcgccactgtactccagcctggatgacagagcaggactccatctcaaaaagaaaggaaaagaaaagaaaaaatattaaatgtgtacgctctttgactcagctgtattacttcaaggagttgatatcaccaaaattgcctaagtgctcaaaggtgtttgtagttaaacaacaggagattgataaattatgttatatacatgtgatgctatgttttaaagaggtactgatatgataaaagatgtacgtggcataaaattaaatgtactttattaagtacttttccaagtgtttacggaatgagtgcatttttgaaaaaaaaaaagtgtattcgaacttttaaaaaagctttaaaagctttatacaatgaacgattgagtgattataagagctggcgggggaatgttaagaggatgatagggagctaagtttaacagaacaattcacctctttatcttgtgacacctacgagcgcatcaattctgtaattgaaaaataaagtgcatatttgcagcagctgtactctcttcaggctgcaaggaggcttttcctcccggtaggcttgatttgcatttcactttcactttcgtggctggaaactttctacccacgtagtgggaggctgaggagccaccataaagctggggcttgacgagccgggaccgggacccgatctccacatatgcccggacttgttctgcggccgggttcaggagtcaaagaggcggggagacctgcgcgacgctgccccgccctgcgcccgcttcctccaatgtatgctctagggggcgggcctcgcggggagcatggacacgattggccctaaagtcttccccgcaaggccgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaaggtgttggaggcactcaaggacctcatcaacgaggcctgctgggatattagctccagcggtgtaaacctgcag

SEQ ID NO: 2123 - DNA, 1464 bp, Homo sapiens
  Genbank Accession No. K02100
aagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaggggaagtccttaggcatgatttttgagaaaagaagtactcgaacaagattgtctacagaaacaggctttgcacttctgggaggacatccttgttttcctaccacacaagatattcatttgggtgtgaatgaaagtctcacggacacggcccgtgtattgtctagcatggcagatgcagtattggctcgagtgtataaacaatcagatttggacacccttgctaaagaagcatccatcccaattatcaatgggctgtcagatttgtaccatcctatccagatcctggctgattacctcacgctccaggaacactatagctctctgaaaggtcttaccctcagctgtttcggggatgggaacaatatcctgcactccatcatgatgagcgcagcgaaattcggaatgcaccttcaggcagctactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacgagaagaggagaagaaaaagcggctccaagctttccaaggttaccaagttacaatgaagactgctaaagttgctgcctctgactggacatttttacactgcttgcccagaaagccagaagaagtggatgatgaagtcttttattctcctcgatcactagtgttcccagaggcagaaaacagaaagtggacaatcatggctgtcatggtgtccctgctgacagattactcacctcagctccagaagcctaaattttgatgttgtgttacttgtcaagaaagaagcaatgttggtcagtaacagaatgagttggtttatggggaaaagagaagagaatctaaaaaataaaccaatccctaacacgtggtatgggcgaatcgtacgatatgctttgccattgtgaaactttccttaagccttcaatttaagtgctgatgcactgtaatacgtgcttaactttgcttaaactctctaattcccaatttctgagttacatttagatatcatattaactatcatata

SEQ ID NO: 2124 - DNA, 2099 bp, Homo sapiens
  Genbank Accession No. K02215
aagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccac

SEQ ID NO: 2125 - DNA, 38059 bp, Homo sapiens
  Genbank Accession No. K02402
gtatatctagaaaaccccattgtctcattccaaaatcaccttaagatggataggcaacttcagcaaagtctcaggataacaaaatcaatgtgcaaaaatcacaggcattcttatacaccaatagcagacaaacagacagccaaatcatgagtgaactcccattcacaattgcttcaaagagaataaaatacctaggaatcctacttacaagggatgtgaaggacctcttcaaggagaactacaaaccactgctcaatgaaataaaagaggatacaaacaaatggaagaacattacatgctcatgggtaggaagaatcaatatcatgaaaatggccataatgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatacagaccaatggaacagaacagagccctcagaaataatgccacatatctacaactatctgatctttgaaaaacctgacaaaaacaagaaatggggaaaggaatccctaattaataaatggtgctgggaaaactggctagccatatgtagaaagctgaaactggatcccttccttataccttatacaaaaattaattcaagatggattaaagacttcattgttagacctaaaaccataaaaaccctagaagaaaacctaggcaataccattcaggacataggcatgggcttggacttcatgtctaaaacaccaaaagcaatggcaacaaaagccaaaattgacaaatgggatcaaatgaaactaaagagcttctgcacagcaaaagaaactaccatcagagtgaacaggcaacctaaagaatgggagaaaatttttgcaatctactcatctgtccaagggctaatatctagaatctaaaatgaactcaaacaaatttacagaaaaaaacaaacaaccccatcaacaagtgggtgaaggatatgaacagacacttctcaaaagaagacatttatgcagccaacagacacatgaaaaaatgctcagcatcaccggccatcagagaaatgcaaatcaaaaccacaatgagataccatctcacacaagttagaatggcgatcatcaaaaactcaggaagcaacaggtgctggagaggatgtggagaaataggaacactttgacactgttggtgggactgtaaactagttcaaccattgtggaagtcagtgtggcgattcctcagggatctagacctagaaataccatctgacccagccatcccattattgggtatataccaaagtattataaatcatgctgctataaagacacatgcacacgtatgtttattgcggcacttttcacaatagcaatgacttggaaccaacccaaatgtccaacaatgatagactggattaagaaaatgtggcacatatacacctaggaatactaggcagccataaaaagaaaatgagttcatgtcctttgtagggcatggatgaagctagaaaccatcattctcagcaaactatcgcaaggacaaaaaaccaaacaccgcatgttctcactcataggtgggaactgaacaatgagaacacttggacacaggaaggggaacatcacacaccggggcctgttgtggggtggggggcgaggggagggatagcattaggggatatacctaatgctaaatgacgagttaatgggtacagcacaccaacatggcacatgtatacatatgtaacaaacctgctcgttgtgcacatgtaccctaaaacttaaagtataataataaaaaaaagatcattctaaaatttatacaagcccttagaacagttaaaaatatcttaccaaaagaagaataaagttggaggaatcactctacctaatataaagtcttactacatagctacagtaattatgacagtgttatattggcagagggataaatacatcaatggcacaaagaatagatagagaaactggaagtagacccaaaacaatatggttaactgacttacgaaaaaatttcagaagccattcagtcgaggaaggatagggtggtattgttgttttttgttttaacaaattgtgctggataaattggacatacctatggaaaaaaaaatgaagtttgacctaaacatcatactttacacaaatattaactcaaaatggagcatgggcataaatctaaaacttcaaactgtaaaacatttagaaaaaaataggaaaaaaactatcaggatctagtgttagtggaagagttctaaatgtgatccataaaacaaaaacaaataaactggactacatcaaaactaaaaaattctactctgtgaaagacctaattaagaggacaaaagacaagctacaggctggagacaatatatttaatccacgtatctatgaaaggattcatatctagaatatataaacaaccttaagaatctgacagtaaaaaaaaaaaatcagactaactggaccactcatacattgctgatggaaatgtaaagtggtacagccattttggtaaacatcattgctctctgacaaagatacggtgggtcccactgatgaactgtgctgccacagtaaatgtagccactatgcctatctccattctgaagatgtgtcacttcctgtttcagactcaaatcagccacagtggcagaagcccacgaaatcagaggtgaaatttaataatgaccactgcccattctcttcacttgtcccaagaggccattggaaatagtccaaagacccattgagggagatggacattatttcccagaagtaaatacagctcagcttgtactttggtacaactaatcgaccttaccactttcacaatctgctagcaaaggttatgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagtttgattatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagaggcttctgcccccttgaagacttcagatgctggggaaaggatagataagaataaggatgaacctggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgtttgcattttcatgctgctgcctttaggttattattgcaacagtttggaattttgaaattaaaacagttctgtaaaaccagtttagttttgtaaagtgtatgcatcaaagatgtccttcattcagacattactgagttacaactacggtgccaggtactgtgtcagggtactaggggtatggggataaaccagactccctctttgatctaaagcagcatgaggccaggtgagaggtttcaatatatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaaggatcactcgtgcaaagactcagctttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgcaaagcccttagcctctatgaatctatcttcctcatttataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagcacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttcgatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttagtcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatgtacacacatatatgtatatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctggaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcaatttgagttctttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattggatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccagaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcccatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcaggggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccgactcaccttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtgaaagtcaattaagtacagaactggagtatgactggccaattatcccatataatgggaattctccacatgtacaaaccacttcatatgctaaacttgttgacaacattcaaagctcatccctgaatttgactatattgattacatcgaaaatgttacatagcaaccttagaatccttgtgtaccttttcttctcaaagcctagattatttctttttccgacgttttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaccgattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactccccattccccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcaggccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctgaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctcccttatctcctgaagtaccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttattattaacatgtgcaatccaggggcaagagaaaggaactgaagatgaggcagaaaggaaaagaaagccaataagaggatgagttatcaaactactcgtttcttaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatagcttgggtaccagaggcatatggcatccatgctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttctttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccagtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcattaaaggatacaatatagtaaatatatcaaatgtttactaatggattcaatgcaataccaaagtgccagcaggcttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtcttgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcataccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaataaagaaagaaccagtgccagatcagcttggtcaggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcatcagacttccattcagggatggcaattgggagtaagactttttagtaaagaaactaaacacaaagtcattagactctgtaaaagtcttaccaaatttgattctggaacacctattctatttccgtaaagatgatgaattcggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgaggctgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcagtactcaggttcagggcactacttcagcttcagcccttgcaaaaactggtgagagttggaaagtctttaggctaagaaaaattggattatttaaaaggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaatgtcctcagttttaacagcattggaattttctgggactagctgtgtatctatccaggattcttgagaatgcctgccatttttcaacataatggatgtaaggtattacacatatacctggggatggggaggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaatgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgcacagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattttaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagactggggcttcagtggtgaaaacattatatatctagctttgaaatatgaaatactgtttagcagtgtcacctagaaaagagtgtttcaaaatgctgatgcttcataagaacctttctcttcagagttggtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagcccaaaccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacggtcatttcttaccttattccagggctttcacctcagcttgccaggctggagccaagggccaacgcagccgcgccttgttcgcgatggtagcttcccaggagccccctatggttccggaacgcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccacttccctcagctttggcctgaagctatctttaaaggtaccctgtacaagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaatgcaaatatattttaggccttttccttggcaaggatgtttggtcaggggttggcaaaaataatgctcttcagacttaaaagaacacaaccatatttcttagccatccaccagaaagtagtagaacgctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatccctgctggggcccagtgtcctgtggctggcaggcaggggatcctaaggacatgtgggtcttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtcgtcacgcctgtaatcccagcactttgggaggccaaggcgggcggatcacgaggtcgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcacaatattccagtttgaaaagggtttgaaaagacctcctagaaaaatcagtagtttttctcttttgagtaacatgtagcaaaaaaaatttcatcatgtaggtacagggaacaccctagtaactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcataccttggctttttgtggattccattgatgtgaatcagtcaccctgtatttgatgatgcatgggactactgacaaaatcactctgaccctgccaagctgctgccttctcctgccccaacctcacccccagccaggcctcactcttgctagttcctttagttcttttagtcaatatatttttgtcttcgcatataagtataaataaacatatttttaaatttcttggctgggcccagtggctcacgcctataatcccagcacttctggaggccaaggtgggcggatcacctgaggttaggagtttcaggccagcctggccaacatggtgaaaccctgtctctactaaaaatagaacaattagctgggcttggtaatgtgcacctataatcccagctactggggaggctgaggcaggagaatcacttgagcctggggagcagggggtgcgggaggttgcagtgagacaagatcgcaccagtgcactccccatcctgggtgacagagtgagactctgtctcaaagaaaataaataaataaatacatttcttgaggcgtttcttgttaaatcattcatggagaggcatcccaaacaccacattcaacaaaacactctgaaaaatgttttcaaatgcaatataacacagcagagatttgatgctctgttatccagttttcatataaggctgtgtgagctgtgtcccagagaggacagtggtctgaatccacctgagacagaattgggtctaactaactgtgagtatggccttcaataagtcactctccatttgggaatttgatttctccacttgtataatgagagtatttgacaggatgctctcccaaatcccttgcaattttgttagtctgtgatttcatgtttttatttttattccttcatccaacaaatagtcaaggagtaattgctgtgtgccaaataccaacagtattcattaaattgtaattcagattttatatatatataaataatgtataatgtgtataaattgctttgtgagtgcctactacactgctagacagtagttgctcaataacttgttagctgaatcagaatccatgtttatcccagagtagcaattagtcttgcatcgagtatcgtgaaagaaggccacacttaaataagaataatgcctggggtttaggttttatgaaaaaatgaaaggaaattagttctgcttttgttgactaaaggaagggaagagagaagagacactataattgtctgcctcagatttaaggaggaggctaattcatgcattaaacacgttacttcaaatttgaatgaccaaaggtctgtagcctcagcacttcaaaattggtaaaagtaagacactctggccttgtttccatagagaccaccccttacaaaggcaccaatgggaaactggcctcaggactcctgttattggtcttctctgtggcagagaaaggagctcttggacccataaatctctgagccacagttctttttgccatgggctcaaaaatgattgaattcatcatgagccacctgtggcatattgccacactaaacatgtggggcctttaagctcactaagagccaatgtcttcagagccagccctggcttgattctacctagggcatttgcagttgccatataagaatcattagtgctttcaaaattactgtagatactttgcctaaatagactaaaacatgctgccgtcatattggaagtgacagattaaaatagaactcttgccaagtgaaggaaagtgtgctaatataatgcagtcattttaacttgctgtttaagtgtgattgtttttagttcttttgaatattatttgttttatactgacaggaacgaagtactgtccaattttctctgccaaggaaaaaagaaaaggtgttcttccttacttacctgaaccaaaacagaccagtttacaaaattgcctaattataattgctaaacaagttccgaatgcttacagtctaatccaagaatgtcagagctgcaagggcccttaaacaccatccaatccactccactcatttagcagatgaagagattgagggcaacataaggccaggcccaagataacacaatgacagccaggactagagctcaagtctcccaccctgcactttgaaagaataatgctttcaactggagtacattaactctactgtctatatttttagggcagctggggcattctgcattggtggcaatcctctcaacaaccctgggactgaaaactgcctggaattcttactaacaattctctaattgaccaaaaggtgacgaaatcaaggagaccaataaggtagccttggaaagcaagagtggc

SEQ ID NO: 2126 - DNA, 2461 bp, Homo sapiens
  Genbank Accession No. K02766
  unsure (1)..(2461): n = a or c or g or t
tcagcctgccggagctttgcagttgcaatctgcnttttagaaataancatcctcacagcacagtacacgaccagttatgacccagagctaacagaaagcagtggctctgcatcacacatagaccgcagaatgagcccctggagtgaatggtcacaatgcgatccttgtctcagacaaatgtttcgttcaagaagcattgaggtctttggacaatttaatgggaaaagatgcaccgacgctgtgggagacagacgacaatgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatccccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataatttttttttaatttttcttccttaaactcctgtgatgtttccattttttgttccctaatgagaagtcaacagtgaaatacgcgagaactgctttatcccacggaaaaagccaatctcttctaaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagc

SEQ ID NO: 2127 - DNA, 1176 bp, Homo sapiens
  Genbank Accession No. K03192
cgactgcgcgccaatatcgatcccaccctcttcctcatccgcacattctccaatgtcatcagctccattgtctttggggaccgctttgactataaggacagagagctcctctcactgtttcgcattatgctagtaattgttccagttcacgtcaactccacggggcagctctatgagatgttctcttcggtgatgaaacaactgccaggaccacagcaacaggcctttcagttgctgcaagggctggaggacttcatagccaagaaggtggagcacaacacgccactggatcccaattccccacgggacttcattgactcctttctcatccgcatgcaggaggaggagaagaaccctaacacggagttctacttggaaaaactggtgatgaccagtttgaacctcttcattgggggcaccgagaccgtcagcaccaccctgcgctatggcttcttgctgctcatcaagcacccaggagtcgaggccaaggtccatgaggagattgacagagtgatcggcaagaaccggcagcccaagtttgaggaccgggccaagatgccctacatggaggcaatgatccacgagatccagagatttggagacgtgatccccatgatttggcccggcagagtcaaaaaggacaccaaatttcgggatttcttcctccctaaggggaccgaagtgtaccctatgctgggctctgtgctgagagacccaatttttttatccaagccacaggactttaatccccagcatttcactgaattagaaggggcacctaagaagagtgatgcttttgtgcccttttccattggacagccgaattgtttcggagaaggcctggccagaatggagctctttctcttcttcaccaccgtcatgcagaacttccgcctcaagtcctcccagtcacctaaggacattgacgtgtcccccaaacacgtgggctttccacgattcccacgaaactacaccatgagcttcctgccccgttgagcgagggctgttgcggtgcaggtctggtgggcggggcagggaaaggcggggtagggcggggttggcggaagaggcgggtataagatgggggaagatgcgggaaaggaaggggcgtggtggctagagggaagagaagaaacagaagggctaagttacttataaggtgcttcgagctggatg

SEQ ID NO: 2128 - DNA, 2856 bp, Homo sapiens
  Genbank Accession No. K03195
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggctgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcctttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgataagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatcgcattattttgaatgtgaagggaa

SEQ ID NO: 2129 - DNA, 383 bp, Homo sapiens
  Genbank Accession No. K03460
ttctctggcaggtgggcattaactaccagccccccacagtggtccccgggggagacctggccccggtgcagcgggccgtgtgcatgctgagcaacaccacggccattgcggaggcctgggcccgcctggaccataagttcgatctcatgtatgccaagcgtgcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtgggtggctcccctccagggatggctgctccacggtttgcattaaaggttctgtataaggccaag

SEQ ID NO: 2130 - DNA, 267 bp, Homo sapiens
  Genbank Accession No. L00190
ctgcaggtaaatgaagaaggcagtgaagcagctgcaagtaccgctgttgtgattgctggccgttcgctaaaccccaacagggtgactttcaaggccaacaggcccttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacatt

SEQ ID NO: 2131 - DNA, 2550 bp, Homo sapiens
  Genbank Accession No. L00352
accatttgttggcagagacagatggtcagtctggaggatgacgtggcgtgaacatctgcctggagtcccgcccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggcctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaacaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtatggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatg

SEQ ID NO: 2132 - DNA, 1807 bp, Homo sapiens
  Genbank Accession No. L00389
tgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgccgttctccatcaattgaagaagacaccaccattctgaggccagggagcgagtgggggccagccacggggactcagcccttgtttctcttcctttctttttttaaaaaaatagcagctttagccaagtgcagggcctgtaatcccagcattttaggaggccagggttggaggatcatttgagcccaggaattggaaagcagcctggccaacatagtgggaccctgtctctacaaaaaaaaaaaatttgccaagagcctgagtgagagaggcaagtcccatctcaaaaaaaaaaacaaacaaacaaaaaaaaaaccatatatatacatatatatatagcagctttatggccatataattcaccttcttttttttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagattgtgcaacctacaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgtaccacccgcctcagcctcccaaagtgctgggattaacaggtatgaaccaccgcgcccagcctttttgtttttttttttttgagacagagtcttcctcttgtctcctaagctggagtgagtggcatcatctcagctcactgcaacctctgcctcccaggttcaagtgcttctccagcctcagccttcccaagtagctgagactacaggcacacaccaccacgcctggctaattttttgtattttttagtagagacggtttcaccatgttggctagactagtctcaaactcctgacctcaatgatctgcccgcctcgacctctctcaaagtgctggcattacagtgtgagccacggtgcccggcccacaattaattttagaacattttcatgacccctaaaagaaaccctgcaccctgagcagtccctccacattctcccccatgcctgcctccccctgcctcaccacccctggcaactgctaatctacttttctgtgtctatggatttgccttctctaaacatttcatataaatggaattacacaatg

SEQ ID NO: 2133 - DNA, 2718 bp, Homo sapiens
  Genbank Accession No. L00972
gaattccgctaagggatcagaaaactcgctggttaatgagtggccaagaacatatcagcttaagtttgggaaaaacacacaacagggcattgtgtcagagggtgaccaaagtgactccccagcagatggaccagggaacgaacaggtgacctttgaactgaggccggagtggaagcagcgagggtgtgaagggccgggtgagggtcaaaggcagaagcaagcaggtggggagggttagcgtcatgcctgctaaggagcagtggacgggtcctagcacgtcctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagagcgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggccaatggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtcctgcgggcactggggcctgagattgtgaggacgcccaccaatgccaggttcgactccccggagtcacacgtgggggtgtcctgccgtctgaagaacgaaatccccaattctcacatcctagaccagtaccgcaacgccagcaaccccctggctcactatgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatcaccacggtgctggacaggacggtggtggacaagtggttcaagagcaacgatgaggaggcgttcacctttgcccgcatgctgatcgcgcaagaggggctgctgtgcggtggcagtgctgacagcacggtggcggtggccgtgaaggctgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatccctccacgggctgccccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacaccaaaaaaaaaaaaaaaaaaaaaaaaaaaaaaaaaaaaaaaaaacggaattc

SEQ ID NO: 2134 - DNA, 1301 bp, Homo sapiens
  Genbank Accession No. L03411
catcgttgtgagccgctatcagcggccagcgcgggacgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 2135 - DNA, 2136 bp, Homo sapiens
  Genbank Accession No. L04270
gccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcactttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaactcgtgccgctcgtgccgaattcctgcag

SEQ ID NO: 2136 - DNA, 343 bp, Homo sapiens
  Genbank Accession No. L04483
cgcgcggtgtggtggcagcaggcgcaccaagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacct

SEQ ID NO: 2137 - DNA, 1507 bp, Homo sapiens
  Genbank Accession No. L04490
ggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagag

SEQ ID NO: 2138 - DNA, 2576 bp, Homo sapiens
  Genbank Accession No. L04751
gaattccgcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcattgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctggacttgctggctccttgctccttgctctcccaggatcaattgtatcttgagttaaaagaacctgctctccattatctcaagtaacagagcagatgctaaaccgtcacagctgtaaattgtgtgcttaatgcaacatgccctttcgacccaccccccattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctggcttgtctgttcctatattagtttcctattactgctgtaataaactatcacaatctcagtgattttaaataaaaaaaaaaaaaaaaaaaaaaaaaaaaaaaaacggaattc

SEQ ID NO: 2139 - DNA, 2657 bp, Homo sapiens
  Genbank Accession No. L05144
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggcagaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaacgtcacgcccataggctacatccccaaggaggatgccctgaacctgaaaggcctggggcacatcaacatgatggagcttttcagcatctccaaggaattctgggacaaggaggtggaagacatcgagaagtatctggtggatcaagtcaatgccgacctcccctgtgaaatcgagagagagatccttgccttgaagcaaagaataagccagatgtaatcagggcctgagaataagccagatgtaatcagggcctgagtgctttacctttaaaatcattaaattaaaatccataaggtgcagtaggagcaagagagggcaagtgttcccaaattgacgccacctaataatcatcaccacaccgggagcagatctgaaggcacactttgatttttttaaggataagaaccacagaacactgggtagtagctaatgaaattgagaagggaaatcttagcatgcctccaaaaattcacatccaatgcatactttgttcaaatttaaggttactcaggcattgatcttttcagtgttttttcacttagctatgtggattagctagaatgcacaccaaaaagatacttgagctgtatatatatatgtgtgtgtgtgtgtgtgtgtgtgtgtgtgtgcatgtatgtgcacatgtgtctgtgtgatatttggtatgtgtatttgtatgtactgttattcaaaatatatttaatacctttggaaaatcttgggcaagatgacctactagttttccttgaaaaaaagttgctttgttattaatattgtgcttaaattatttttatacaccattgttccttacctttacataattgcaatatttcccccttactacttcttggaaaaaaattagaaaatgaagtttatagaaaag

SEQ ID NO: 2140 - DNA, 2100 bp, Homo sapiens
  Genbank Accession No. L05779
ggcacgagctctctctctctctctctctctctctcgccgccatgacgctgcgcggcgccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctggcctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtagtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgac

SEQ ID NO: 2141 - DNA, 357 bp, Homo sapiens
  Genbank Accession No. L06499
acctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttggagacatcactggcctataataaatgggttaatttatgtaaca

SEQ ID NO: 2142 - DNA, 612 bp, Homo sapiens
  Genbank Accession No. L06505
ggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtga

SEQ ID NO: 2143 - DNA, 1670 bp, Homo sapiens
  Genbank Accession No. L06797
cggcacgaggcaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaagagacttttttttatacgataaataacttttttttaagttacacatttttcagatataaaagactgaccaatattgtacagtttttattgcttgttggatttttgctcttgtgtttctttagtttttcgtgaaggtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaa

SEQ ID NO: 2144 - DNA, 1568 bp, Homo sapiens
  Genbank Accession No. L07033
gaattccggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctgaccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 2145 - DNA, 3779 bp, Homo sapiens
  Genbank Accession No. L07077
gggaaacatggccgagtatacgcggctgcacaacgccttggcgctaatccgcctccgaaacccgccggtcaacgcgatcagtacgactttactccgtgatataaaagaaggactacagaaagctggaagagaccatacaataaaagccattgtgatttgtggagcagagggcaaattttctgcaggtgctgatattcgtggcttcagtgctcctaggacatttggccttatactgggacatgtagtagatgaaatacagagaaatgagaagcccgtggtggcagcaatccaaggcatggctttcggagggggactagagctggccctgggctgtcactataggattgcccacgcagacgctcaagttggcttaccagaagttacacttggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattggtgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaccccatcacattgaaccacgtaccattagccaggatgagatccttgaacgctgcttatattcacttatcaatgaagcattccgtatcttgggagaagggatagctgctagcccagagcacattgatgttgtctatttacatggatatggatgcgcaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttacctaaggctagaattgggggtgatgaatggggagtacaggattcatctaatgggtacaggatttctttatggttcatgaaaatggtctaaacttattgtggtaatggtcacataacaatatattagaaaaccattgagttgtatattttaagtgggtgaattatatggtatgtgaattatatctcaataaaggtgttagtaaataaatgggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagt

SEQ ID NO: 2146 - DNA, 3061 bp, Homo sapiens
  Genbank Accession No. L07597
cgcggcgcagggccgccggagagcgcgggtgacctggcggcggcagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcacgccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcttgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagatgcttccagagggagcaggccggaaccacagggccagagggagctggaaccgaggggccggggaagctgccagcccagaacacccctaatgagggtgtgagaagtgccttctccttccccaggatggactcttctcggctcaggctctgctggtggaaagcgattcactgtataaactttttttatgaaaaaaatggcatcaaccaccatggatttttacaagatccatttgcctttctgggagcagaaacagccattgcggcccaggaggggaactgagtcacgctggggctctctgagactctttagagcagctttgggatcccaccctgggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttgctctgccagtggatccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaatggaattc

SEQ ID NO: 2147 - DNA, 1966 bp, Homo sapiens
  Genbank Accession No. L07765
tctttcttcatccccgcattcccaatatacccaggccacaagagccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttggcaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcgggccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaca

SEQ ID NO: 2148 - DNA, 2955 bp, Homo sapiens
  Genbank Accession No. L07956
gatctgaattcggtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactccaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagataggagaatatgtttaaaatattaggaatcctagaccatattttcaagtcatcttagcagctaggattctcaaatggaagtgttatatataatatgttaaaaacattttgctttcctggctaattatttgatccttttaaatccaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaaaaaaaaaaaaaaaaaaaaaaaaccgtcgacaaagcggccgcaaaccgaattc

SEQ ID NO: 2149 - DNA, 398 bp, Homo sapiens
  Genbank Accession No. L08044
gatgctggggctggtcctggccttgctgtcctccagctctgctgaggagtacgtgggcctgtctgcaaaccagtgtgccgtgccggccaaggacagggtggactgcggctacccccatgtcacccccaaggagtgcaacaaccggggctgctgctttgactccaggatccctggagtgccttggtgtttcaagcccctgactaggaagacagaatgcaccttctgaggcacctccagctgcccctgggatgcaggctgagcacccttgcccggctgtgattgctgccaggcactgttcatctcagtttttctgtccctttgctcccggcaagctttctgctgaaagttcatatctggagcctgatgtcttaacgaataaaggtcccatgctccacccg

SEQ ID NO: 2150 - DNA, 3188 bp, Homo sapiens
  Genbank Accession No. L09229
cgggcagtgacagccggcgcggatcgcgcgtccacggaggagaatcagcttagagaactatcaacacaggacaatgcaagcccatgagctgttccggtattttcgaatgccagagctggttgacttccgacagtgcgtgactcttccgaccaacacgcttatgggcttcggagctttttccagacgactcaccaccttctggcggccacgccacccaaaacccctgaagccgccatggcacctctccatgcagtcagtggaagtggcgggtagtggtggtgcacgaagatccgcactacttgacagcgacgagcccttggtgtatttctatgatgatgttacaacattatacgaaggtttccagagagggatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggactcgtacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccaccgtgaagcgatggctcttggactttgcctccaagaggaaagaagcagacgttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccacaggccatgttggggccccgatgccgtgcaatttgataaaacttggttggcagttggaagaaatgaattacatggcgtccgagggcgagggcgaggtgtgtgtgaaagggccaaatgtatttcagggctacttgaaggacccagcgaaaacagcagaagctttggacaaagacggctggttacacacaggggacatcggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccatcatcaaggtttagtgtgaagaagaaagctcagaggaaatggcacagttccacaatctcttctcctgctgatggccttcatgttgttaattttgaatacagcaagtgtagggaaggaagcgttctgtgtttgacttgtccattcggggttcttctcataggaatgctagaggaaacagaacactgccttacagtcacctcagtgttcagaccatgtttatggtaatacacacttccaaaagtagccttaaaaattgtaaagggatactataaatgtgctaattatttgagacttcctcagtttaaaaagtgggttttaaatcttctgtctccctgtttttctaatcaaggggttaggactttgctatctctgagatgtctgctacttcgtcgaaattctgcagctgtctgctgctctaaagagtacagtgctctagagggaagtgttccctttaaaaataagaacaactgtcctggctggagatctcacaagcggaccagagatctttttaaatccctgctactgtcccttctcacaggcattcacagaacccttctgattcgaagggttacgaaactcatgttcttctccagtcccctgtggtttctgttggagcataaggtttccagtaagcgggagggcagatccaactcagaaccatgcagataaggagcctctggcaaatgggtgctgcatcagaacgcgtggattctctttcatggcagatgctcttggactcggttctccaggcctgattccccgactccatcctttttcagggttatttaaaaatctgccttagattctatagtgaagacaagcatttcaagaaagagttacctggatcagccatgctcagctgtgacgcctgataactgtctactttatcttcactgaaccactcactctgtgtaaaggccaacggatttttaatgtggttttcatatcaaaagatcatgttgggattaacttgcctttttccccaaaaaataaactctcaggcaaggcatttcttttaaagctattccg

SEQ ID NO: 2151 - DNA, 945 bp, Homo sapiens
  Genbank Accession No. L09604
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgacgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatataaaaaaaaaaaaaaaaa

SEQ ID NO: 2152 - DNA, 3311 bp, Homo sapiens
  Genbank Accession No. L09708
ggatccttccaccttgcctaccaaagtggggatgaaagtttgtctggggcattgcagttttagacaggaagaccagggaaggcctcactgagaaggtgacatttgagccaagacttaaaaaggtacgaaagtgagccatgtggaagtcttggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccaaaggcccgttttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatccgtgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtcttggatgggagggtgccctgcagggaagagtgctctggagatccctggaagagactactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggacttcgccatgttggccaggatggtcttgaactcctgacctcaagtgatctgcctgcctcaacctcccaaagtgctgagattacaggcgtgagccactgcaccccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatcc

SEQ ID NO: 2153 - DNA, 855 bp, Homo sapiens
  Genbank Accession No. L09717
gcatacgcagatatatgattgaaaatcactttgtgacatctcatttgctgataatgaaatgccaatgactgttaccttgtataaaaaaccaaatatgcgtgttagaagtgctgtcattttactcaaaatacacagatttgaaagtttgtcactgtttctgttctcaattgtcctttctccacatctagctcaagactgcagtgcagatgacgacaacttccttgtgcccattgcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaagggtctatcttaaccaagccctggccaaattttgacctaacttgaagtatccttgaacttattaacatggccattataagaataaaatatgtagttgtgtcttaatggaattaataaatgtcatttcactactggtgttctgtttcaatctataaggactatagtgatttaaactcatcaatgtgcctttgcataaagttcattaaataaatattgatgtggtataaatgcccatcagatatgcttaaacttggttttcagttgaatgaagtagag

SEQ ID NO: 2154 - DNA, 4957 bp, Homo sapiens
  Genbank Accession No. L11005
gaccgaacacgttctttaggctccagcaaagcgccccactcggcgggtcggtgccgccgggtcccaggtgcccgctacttcccagaactcgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactccgtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctaccccctgctcaggaaccacccagagcccactctggatcagttaactgatgcccttggtggtaacctgtgccgttgccatggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgataaacagtcgcaaaggaccagggtgtttggcagtgagagaatgatgtggttttcccccgtgaccctgaaggacctgctggaatttaaattcaagtatccccaggctcctgttatcatgggaaacacctctgtggggcctgaagtgaaatttaaaggcgtctttcacccaggttataattctcctgatagaattgaagaacctgagtgttgtaaaccatgcatatatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatccccatctcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagtgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttgcgtcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctctggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttggatgtgactcctacttggcttctatcaccaacagaaattataccatatagtgaaaggcaattttctaaataatttcattactaatatgaactgtgaagttgtcattttttcatttgtccttttctgctatcaccttcctcttgtcagaatgaatatagacacatgtatctaagtgggaccaaagaaaaaatagcgaactttcaccaaagttttcatgaaaacccaaaagctttaaaagttactatcaagaaattgaaaggaaacccacagaataggataaaatatttgtaaatcatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtgtcaataaaattttttaatggg

SEQ ID NO: 2155 - DNA, 1157 bp, Homo sapiens
  Genbank Accession No. L11244
attctgtctttcacatacattgagaccaaaaagaccaagtacctataagaggaccaacccagacgggctgtgacaattacgctgttgcttctgagtgagaagttacaggcccaagaaagggtaatgacagccttagagatacataaaagagacaagcaatttccaaaacaaaaagcaaaggcaaaaagaaaaataaaaaagcaggcctttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 2156 - DNA, 630 bp, Homo sapiens
  Genbank Accession No. L11566
gcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacaaaaaaaa

SEQ ID NO: 2157 - DNA, 1758 bp, Homo sapiens
  Genbank Accession No. L11669
cgcccctttagggtgctcgccggctgtcgggtgtgggggtatgccaggccccggaggactcggcttccccgctaacccgacccgccgcaccccacccaggccaggtcagagcagcccaccatgggatggggagggggtggaggctgcaccccccgcccacccatccaccagcagccgccggagcgccgcgtggtcatcgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgtttt

SEQ ID NO: 2158 - DNA, 1344 bp, Homo sapiens
  Genbank Accession No. L11708
cagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctga

SEQ ID NO: 2159 - DNA, 1669 bp, Homo sapiens
  Genbank Accession No. L11931
gctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggagacccccacctgagagatggatgagctgctccaaagggaactgttgacactcgggccctttgagggggtttcttttggacttttttcatgttttcttcacaaatcaaaatttgtttaagtctcattgttagtaattct

SEQ ID NO: 2160 - DNA, 5784 bp, Homo sapiens
  Genbank Accession No. L12350
acggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcataggaccagttgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctcgatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggcttctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggtcacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgctggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagaccggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgcggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgctaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgttgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaatatataatgttgccagcgattttagttcaatatttgttactgttatctatctgctgtatatggaattcttttaattcaaacgctgaaaacgaatcagcatttagtcttgccaggcacacccaataatcagtcatgtgtaatatgcacaagtttgtttttgtttttgttttttttgttggttggtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacgatccataactttagtcttaatgtacacattgcattttgataaaattaattttgttgtttcctttgaggttgatcgttgtgttgttttgctgcactttttacttttttgcgtgtggagctgtattcccgagacaacgaagcgttgggatacttcattaaatgtagcgactgtcaacagcgtgcaggttttctgtttctgtgttgtggggtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttct

SEQ ID NO: 2161 - DNA, 2069 bp, Homo sapiens
  Genbank Accession No. L12711
taacacgttgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccacggcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcaaaacaatggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgag

SEQ ID NO: 2162 - DNA, 4892 bp, Homo sapiens
  Genbank Accession No. L12760
ctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactggtaagctcggcccccgctgcctgtcccagcaccctgcaggcagggctcccctgcgtctcctgggagttggtggagaaaggtgaatgaaggccttcgggtagtttcagactcttgagaagatgaatgcaatggtcagaaccatacagacttgaattttgtgacattagtgggccagcccaagctttaaatgaggtgtgtgcacaaaagctctgccaactagattcctgattaaaaaaaaggcagcccctctcctacagaccagctcctagtggagtaaatgtccacctggccatgtcttagacggtctgtgtgttcacagtgatggactgttgttagcgtgctcagcactctgctaggcatggaaagccacggtactgaaggagatggttcgctgcccgtggtgcttggctgaaaggaagcctgtgatttttgcagctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtgagcggaacattgatttgattgggtaaaacagcagagagccttttcttatttacatctatcctaatggtaattcaaacaataatggaagctccaccacctcagatgtctttcagttccatacatgaagttggcaatgtattgaaaatgcacatccctcttctgcttttacagactgtcttatacaaacgtgaaaactagttccatgcatatgggttttaaatagcttggtggacccaattgcacatttatgaaaactctttaatttcagcaggctgttcactttccagtggcctcttctaacccagggcctggtgaccagcagggtgtggtggtgttagtggaacaccgtgaaaatgggtctacctgggaaaaaaatgctggtcgtgttcgaagtccaaggtcatttctcaccagtgcccacccatcgcaccctgtaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaagtaagtgtattatttcagaatcaaaagtcaaaataaaaaagaaagctgaacgcaaaccccagtgagtgcctcggggacccccaaccagggccctggcgcactgacttgggaggggtccttgttcacagagcctttggtcaacaactggccctgcaacccggagctgacgctcatcgcccacctgcctgaccgcagagagatcatctcctttggcagtgggtacggcgggaactcgctgctcgggaagaagtgctttgctctcaggaatgccagccggctggccaaggaggaagggtggctggcagagcacatgctggtgagctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatatacatcgcttttgaagggcccccaaaacaccaggggaccatagagatccttttggacttcatgattcttgggagtgttgttgcactgatacctgaaggaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcatttcccagcgcctgcgggaagtccaacctggccatgatgaaccccagcctccccgggtggaaggttgagtgcgtcggggatgacattgcctggatgaagtttgacgcacaaggtgactcttttagacccaactcttggtaacgattggactcaagcgaatcgttggccttcgaaacatgtcacattctcctcagtccagtgtttggatttttaaactctgttagtccagagttggccaagccttagaatatggatcctgtaagaattcttcaacttaatattcaatctggattgaaactgggccatatgttgctgtttgtttacatacatacatttgtttaaatggtattggtggaaaattgtggaggaagcaagagtcgtaaacgtatcaaagttgcatatgatgcttggatgaaaagagataaatgcatattctagggagggaaaaaagatttgagaagttggcatagaaattagtccggcaatatataagagtatatgttctgctttgcctggcactcactactgcttctctggtttaaaactctccaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggtgtgtccctgccagaggcctgtgtgtgccgggctgcagggactgcctgttttgagccaggcactcacgagcctttctctgtcttataggggaaccttgtgcccaccccaactcgaggttctgcacccctgccagccagtgccccatcattgatgctgcctgggagtctccggaaggtgttcccattgaaggcattatctttggaggccgtagacctgctggtgaggctctccttcatttaggctgggaacatgggtgtgctgggtaccgaaggcatctgtgaaatctctccttttccatgaccttgtcagagggtgcccaggggcttcctttcttgagcttccttcccaaagatccagaataattggcaagttcaaatgtagaaccaacccttctggtcacctggaacctttctgaatccttgatctattgtagcttgatcaaattttactttttactttgtggcctcagtcatgtaactttgagttagcagttttctgcaatttagcttggtgaatgcaaaactagctcgattacaagttattgtcttgccgtgtctttccgtgttgtgaataacaccactggttgtggagtctgaatttcaaagcctctgatgaacatttctctttttttttcctgctaaaggtgtccctctagtctatgaagctctcagctggcaacatggagtctttgtgggggcggccatgagatcagaggccacagcggctgcagaacataaaggtaaatcaaagtcctgatctgaaaccacagagaagtgggattagagcactcttcgtcactcttatgtctctctccttttctgtgtctgtgtgtggggagagagagagagagaaagagagagaggagaacaaagcatgctaatgtcaacaatcaatggcgtcagtcttgcctaggagagcctcatttactaatgaactccctctctgtttaacaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaaggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatgtgtgtgtgtgtgtgtgtgtgtgtgtgtgtgcatgtatgtgcacatgtgtctgtgtggatatttgtgtatgtgtatttgtatgtactgttattgaaaatatatttaatacctttggaaaaatcttgggcaagatgacc

SEQ ID NO: 2163 - DNA, 1796 bp, Homo sapiens
  Genbank Accession No. L13278
ctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctggtaacataataatgtgtaataaagtct

SEQ ID NO: 2164 - DNA, 3203 bp, Homo sapiens
  Genbank Accession No. L13689
gagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacttgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggagttccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcagccattacgactttctagagctaatacatgtgactatcgtccaatttgctttcttttgtagtgacattaaatttggctataaaagatggactacatgtgatactcctgtccgtcttggttcaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaaacaagtgctttttatcttgaaattcaaccaacggaaagaatatgcatagaataatgcattctatgatgccatgtcactgtgaataacgatttcttgcagctatttagccattttgattgctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatctataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcagttatttgtgagggtgtttattctatatgaatattgtttcatgtttgtagggaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaa

SEQ ID NO: 2165 - DNA, 2388 bp, Homo sapiens
  Genbank Accession No. L15702
tcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 2166 - DNA, 808 bp, Homo sapiens
  Genbank Accession No. L16883
tcatctcttctacaattcactgaacagttattgcatattctgtttgtgccagttacagagacagtgtttgtcactgtcacagttacgcatgaggagtaactgctctctgtgtttgctattttcaggaaaacggatttgtgtgggagaagccctggccggcatggagctgtttttattcctgacctccattttacagaactttaacctgaaatctctggttgacccaaagaaccttgacaccactccagttgtcaatggttttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgagtcagtttattagaccttccttcttttatgcaaaatgtaggtcagaaattaaagaaaatagagttccaggaggccatgctggttctcaaaatgataaggacagaaaggacaaagaggaagagggtagggaagctattt

SEQ ID NO: 2167 - DNA, 2523 bp, Homo sapiens
  Genbank Accession No. L17128
tgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctgcctcctcggcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctggaacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaaa

SEQ ID NO: 2168 - DNA, 10144 bp, Homo sapiens
  Genbank Accession No. L17131
  unsure (1)..(10144): n = a or c or g or t
ccaccttgatcatggctcgctggtggccattaataaaacactttggatttcacaagtttcacgtttgaatttcacaagacttgtatctcaccaatcagccacacgcgggttgacactgaaaggcacatgctgacacctgtccgcccaggggaaatctaccatctctctattctagttagggggcggcgtgtaggccggaattctctaacgagcgcgtttctcttcaccccctgggcccgcgtggacccccgtccacccccacacgccctggaggggggccgggcccacacgccctggaagcccctagaggtgactctccctgggacccctgtaccagggaggaaggataccgccacccgtcaccaccaccccccgccagaagctccttcgtgactcctctgcgcgtgccttcccacacctcctcgtccgggactgcgaggagtgggcggtcgactcgagttcgcagcccaggcctcccacacgcccctccctgccgtcagcacccacccgcgcggcaggccggcggctggcgggcggccgcttttaaatccccgggctcatttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgctccaagaaggcgtgagttcgcggccgctccggtggcttcttttttttatatctataatttaattaaattatttatttattgaggccgcgcacgggccgtgcccagcttcctgcccctcgccatccttcgggnnagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagcaggcgcgtcctcagcgcccagcaccgccgctcccggcaacccggagcgcgcaccgcaggccggcggccgagctcgcggtgagtcgtccccggggcccgcggcggcggcggcggaggggggcgcccgcgccccgcccgacgtcgcccctcctcnagccgcccggggctgcagcgcgcgccgccggctttattcccaggccggggcggcgcgaccggcggcgggggagggccgcgcggcgcgggggcgggcggcggggcccggcggcgcggggaggacgcccgcaccccttccccgcgccgcgggcgcctgcggggggcggggacccgggaaaggcgcgcggtgggggagggggcgcgcagctgcggcgagcgcgagttgtgcacccggcggagcccggaggagcccggcgcacctcgcgcggcggccgctcccgctggagccggagcccgagcccgagcccgagcccgggcccgggtgaggggcggggagagacacgggctgcggcgcggcaggagagtggggggtcgggcgccccccgcagctcagggaagttctggaagtgagggagatggggaggaacccccaaattcggccctacgccctctcggcctttctctcgcgccccctccgcagatgaggccggagcgcgggcctgggtttggggcttcaccccgaccccacctctggcctggcccgcgcctcttcagccccaggggccgggcctgccctccgcccccacaaactggtttcgctgctttgctgggctctgttggaactagtccctttgactccccgtttctattttattttcttctggggctttattttgccggggaggggacggagggagggggctttcttcctctcccccgcgcccgcgnccaggtttcctgccccaaggcgggcttgggtgccccctctggcaggaagtggggccgggtgcacccgcgtggcgtgcatgcggtcggggtgcgctgctttcccgcgcctgcaggagcgcctgcgcccctccccccgcgcgccctggccccgggtcccgccggcgcctgcaacggccgggcgcagacacttgcagagtcaccctcgggccgggtctggagcctgatgcctcgggggtttagccctagccgctaggcgggtaggcaaagtgtcggattgaaagggtctccgggaacctacttcttcctgctcgccaacttgctgtgtgaccttaggcaactcaaggcttctctgggctacttttttacgggggacggggaagaaaacaagggaacccccaagataatttcctagggcctttcctgcagagtccttaagtatttgaggagcacagtttgcatgcacagtgtatggaggagacaggcttgaggccaagcggcgttattacaaagtgagggattggggttaggccctaaatgtagttcctccaagacaggcctctgatgttcagaaacaggtggaaaagacgaacgtttcttggcctcactggaaagggcctcgggcttcatttagttcgtggggggttggctgaggggattaaagggtccccagcagcaagaggtggggggaggcaccagatggtatgagagcttccagggagacccgccaagatctccaggcagccgggccagctctctgggattccggactgcttcgcccaactggaaccccctcgatgagggggccccaagcagaccttatatgaggtcagcactcgtttagttgattaattttgatgtttagtttgaaggggacctgtggtgtaatataagattctaatcactgcctgtaattgcagagcagccaagccactaatgacggagcaggataaatcaccaaccaccttgtttaaaagggtctccaagtctgaaacattataagatagaataattaccaaagtcctgctgtctggagggtctcttgatgcttgaaaatggaggtcctgggccctctagaaatcacaagtttgcaaaaatgtttttttcctctcattggggtaaaaactctttttcttcttttttttttttcttttaaattagacatgggagtcccaccgtattgtccaggctggtctcgaactcctgacctcaagcagtcctcctgctttggcatcccaaagtgctgggattacaggcatgagtcacctcacctggcccataaatcattttcaaatggtctagttcttattttggttagagtgaagatttctttctattattttaagtttttctaaactattacctagtttgatccttgaagcagtcaggaggtagttcaggcaggtaccttataattaccttgatcttacagattgagaggggttcagaagtggagccgcttgtcccaccccttaccatggcaggcagggattggttactggaaaaatgtgtagcctaggcctccggcgtctcatccatctgtagcctggggataaggactaggataagaagatgtggaggactgtcctttttaagcctgtaatacagggtattcccaaatacaggttgcaggccctccttccaatgagaagttttaggaaaactcaaaattgatggggttaattaaaccccaacaggcctctaagaagaaggaagatgctagaaaatgaccaagaaggttttaggatgagccctaaacctcatcctaaaggatgagggccagccagggtctgttaggcgggtgcatttcagttggagaattccctacccatctgacaaagtcccatctgactccagttgggcagaggagggggtaaggggaaagaggagggtggcctttggctttgggctcactttcctcccccactcacccactagcttcaaccatctcctccctcctcaattataccaatctgaattctccagggatttaccctgggtgagaacagagaagagagctggtggtgggcaccacccctggctgtgtgattggctctttttggtcctgagtcttgcaccttgccagataggcaatattgtcagtgaggtgggcaggggatcaatgtccatagctgccagatcgcaaggtctcattctttccattttcccactgaactgcgtaggctggattttctcttaaagagaaagggcagcagttgactacagaaggaggggatgctggcaatacgtcagatctcacctccccacacctttgtcccagggtggcctcacccatgtagctaggtctgggctggctgtacctcctggaccccccccaccacgctgcactggggcggtgttaaggcaggacaacaaagagcccttctgaacaggagatagataagaagctgattagccaacggcccttccccgcccttggcagcatctgggggtgggcagacccctccgcatcctgggcagagtaggagcctgggggcccatgggagcacagttttctgcagtgtgccttgaaggtgtgggtgatgagggggtagaaagtggctgaagcgagatgtttgtctaaaagcacttttctgtctcccagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcaggtgggtgtccaaacctttgcttcacttggtttaccctttggggctagggaggtgcctggagtttcattcagcaggcgagaccatgcatggagggtgcagaatgattctgcgcagtaagcgtgtgggtgtgtcctcccacctgtgtgtactcctgccccacttgcaaccctggtcagatctctatagagaccccaggagagaaccgggggccgaggaattcaagataaattctgaagccaatggcaaacagtccaaacctaaagcaccccagaggtcacatggccagtgcttaaaacactcgcctttttcttaatttccaatccactgtggaccagtaattttaaaatgcagtaaagacgaatgaacaaaaatgaacatagaagcccagggtttttaatcattagattcagtgcacgtaaaatgatttttgtcaatttgctgtaaagttgctgaatacttatggtcgattcttgtacttcctcatccccaggtgagaaacgggtgcctgcgtgggccagcacctgtttgtgcacaggccagttatgagtagttctggaatgggcattgcccctggctctttagatggaaattgaagcccaagaagtcaaaaatgttggggagttggtggcagtgaccctcagaaccctggtgctgctctccccacaaagtcctcatagaaggatgaggctgccagcctggcgctgtggggcaccctagggagcatggccatttgggcatgggggggaccccatattgccgtcttacagaggcagctgtcacccaagtgaagggtggctgttggtgaagcccagttacttcccttccctgggagagaggtaagaggagttgagttcgacctctgccccttaaacatgatacaggttgttcacctgcaggttttccctgtccgtacggtggagagtggtctgtgctgacctgggcccagggagacacgagctgtgaggagtctgctgtgttggaattcagagcctggggtggggtcatttgtcctcttagcctagctccctcagccctcccctcctaccccacctgttagccatggtcagtgggaggtgtcaggaggggtgcagggttactggaccctggttatagacagaccatgggcggccccctaggaaacagtagctggccgccgccttcaccacacaccttatatgcattatgcagcagctttttattctatctacggcttattaaaatttcagtgggaatgatggcagggatctctggagtccggctataattccccttctctgggggccagcctggatgggctccaggtttgcaagtgcaggcagggagtgtgtgtccagcataggtcatctgagagggtgggcagtgatcatggcccagtgctagataaccatacattacccatttaatctccatgacaccctgcaagggaagtcttcaccatttatagatgaggaaactgaggctccagcattaagtgtcccacccaagataagtgtcagaactgagacttggcagagccacctaactgtctttctgtccccagaatgcctttcctaggggtcttctgggctcttgacattttgcatcttagaaacctgcagggaagcaaggggagaggtgggaggcactttgcaaagatgctcaaactggagctttggatcctgaagggattcctaggtcagggatggtttgtggttcttggttcttgctgacttaaccttgttgaggaggcagagggctgtgtcttctgagggggtggaaacaggtgatgactgtccctgactaccccctctgtctttacagaaggagcccagcgaagtgccaacacctaagagacctcggggccgaccaaagggaagcaaaaacaagggtgctgccaagacccgggtgagacttgagatgggactacccctgggtggatgactagcagaggatcctcttgttggcaccatggccacggctgtggggaggtctgggaaggggctcagtcatctcagttgtgtacccccttccctggtacagggatggcagtgagtctttgctaactggggagagtggggcgatgactaaggtcttacttctggggggttggtcctgcccaggacactgcggagatcaggtcagaagtcccacagctttcctgatcttagagaagggcagagtggggagaatggagggtccctgccagtccctgggctgagaatgttaccttctcttggggttccctggagcctgaaggggtggggacaggcagcaaaggcccagattcacagtgacattagcctttcagaaaagttgttttgttttttattttattttttctaagacacgactcatatcctctgagtcatgggcggaggtgggagtagggggccgtgtgtgtatgtcgagggggcaaatgtggctggccagtcattgccagctggacttgggtgggcctgttgggtgagagtgttgggtcaccctgaacaggcaggtaggtctgccccccatcactattgggcatcgggtgagcactgatgagcattttggacttaggagatattttctctaaccctctagaaaaccaccacaactccaggaaggaaaccaaggggcagacccaaaaaactggtaggtgaagaagcagactgctgcttgcctcctgggctcttttgagtgagggtgttgagtacacagtacctgatgctatgcaccccctatggaaaggctctccttgacctgctgggacatcagattttacagaagtccagagaggggaaggtacctggcctgggctgtgcccatgagaagtgaggggtcccaggtataaatcagaccacatccccctgccctgccctgccctagttgtgtgtgggggtccctccctctcctgctcctagaatactcagaacttctaggggagatcttggaagtcatctagcctgtgtccccctcaattagagatgaggaaaggaagccatagggggaaggtttgtccttcctatgagcctctgcagaagagaaacagcgaaggagctgggccctgggaggggtcggtgctggagttctgatgtgacccaccacactgcactggagggcaccatccaattctgggnncccaaacagctggtggaaaggctcggtgggctgagtcaagaagctgcctctagggggccactgcagttagggtcaccccagccttccagctcctggccctctcctacccccagcctgccccctcaaatccctgaagctgtcattccttgagctgagccactgctggggtgggggggttagggggtgctgctggccaggccccaagagtgagtaacaggaaacaagttgttttggagtttgtgcctggctcgggggctgtagccgtgtggtgtccacattcccgcccagtgagtgagcccggcggcacacacttccccttcctccccaccccggcctagggtcagccctcggccaccccggagggccagggcaccacagcacagcatctagcccctgtgggccaaggacctggttcccctgcacccaccagcgggctcttgcaccttccagccaccccttcccatttcctcccccagccacctcttccccacctcctcttctcccctagggagtcagtcacatcctgaagctcattgctgccctgagctctgccctcctgccctccctgggcctgggggccaagggggcttggctcctggctctgggtgagagcagcatgtgtgtggggttttttcctccttttaaattctttttatgaatgaagccgggcgcgtggaggttgctgagtcacccacgacgactcagccctgactcatccctcttcaggagagccagggagtgcagggagcgggtggggccagcctctgggggtggaagagggggccaccgggccagagctcacaccaacaactgcccacctcacaggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttcgttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggactggagtctcctgtggtgtgtgcccctaaagccctggggcaggtaggatgggtgacacttgtgttgtggcccccatccttctggctgcaggaagggaggggaaatagcactggaatcacctccggggaaggtcattttaagcctcttgatgaaatcaaaacccct

SEQ ID NO: 2169 - DNA, 476 bp, Homo sapiens
  Genbank Accession No. L19527
ggttggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaa

SEQ ID NO: 2170 - DNA, 1958 bp, Homo sapiens
  Genbank Accession No. L19605
gctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgaaaaaaa

SEQ ID NO: 2171 - DNA, 2167 bp, Homo sapiens
  Genbank Accession No. L19686
ctgcaggaaccaatacccataggctatttgtataaatgggccatggggcctcccagctggaggctggctggtgccacgagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcattcattcattcattcattcagcagtattagtcaatgtctcttgatatgcctggcacctgctagatggtccccgagtttaccattagtggaaaagacatttaagaaattcaccaagggctctatgagaggccatacacggtggacctgactagggtgtggcttccctgaggagctgaagttgcccagaggcccagagaaggggagctgagcacgtttgaaccactgaacctgctctggacctcgcctccttccttcggtgcctcccagcatcctatcctctttaaagagcaggggttcagggaagttccctggatggtgattcgcaggggcagctcccctctcacctgccgcatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaggagtgcctcggggttccttggcttgcgggaggaattggtgcagagccgggacattggggagcgaggtcgggaaacggtgttgggggcgggggtcagggccgggttgctctcctcgaacctgctgttcgggagcccttttgtccagcctgtccctcctacgctcctaacagaggagccccagtgtctttccattctatggcgtacgaagggatgaggagaagttggcactctgccctgggctgcag

SEQ ID NO: 2172 - DNA, 1914 bp, Homo sapiens
  Genbank Accession No. L19871
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 2173 - DNA, 492 bp, Homo sapiens
  Genbank Accession No. L20591
tggtatagctcatgagtctcacacccaggtgaattccctagtgctataggatttgattcatttatggtctcccattatttatactgtatttgtttttcattgattttattctttgcagtcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaac

SEQ ID NO: 2174 - DNA, 1198 bp, Homo sapiens
  Genbank Accession No. L20941
cagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgccctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattcttcaaataaagaaatttggtacccaggtgttgtctttgaggtcttggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctg

SEQ ID NO: 2175 - DNA, 3705 bp, Homo sapiens
  Genbank Accession No. L20965
ggaattcccggccgggcgcacccgcggggccctgggctcgctggcttgcgcgcagctgagcggggtgtaggttggaagggccagggcccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcgcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatcccggtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaaggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaagtcagggagctgggggagctgttcactttaggatacggggggatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccgtaagttatagccactgtggaaagtagtatgaaagttcctcaagaaactaaaaatggaattc

SEQ ID NO: 2176 - DNA, 1580 bp, Homo sapiens
  Genbank Accession No. L21893
aaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctt

SEQ ID NO: 2177 - DNA, 684 bp, Homo sapiens
  Genbank Accession No. L21954
aaactagctgcgatggggagggcttggccaggtcactcaagggtggagtgggggtgagtgaggctcctgactcccaaatccagtgggagttgggcagtgggacaggcacttgggtgaacgcggtgcctcaggcctccccatcctccgtccccaatctctgcaggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcatgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggttgccccacctgagcccccacccgggagcagtgtcctgtgctttctgcatgcttagagcatgttcttggaacatggaattttataagctgaataaagtttttgacttcctttaccatggcctttttgcttgggtgggacccctggccacagggaagagggggagctggggctgcactggagctcgtctctgcag

SEQ ID NO: 2178 - DNA, 3394 bp, Homo sapiens
  Genbank Accession No. L22548
ggagaagttggagcagatggaatccccgggttccccggcctccctggcagagagggcattgctgggccccaggggccaaagggagacagaggcagccggggagaaaagggagatccagggaaggacggactcgggcagccgggcctccctggcccccgcggacccccgggacctgtggtctacgtgtcggagcaggacggatccgtcctgagcgtgccgggacctgagggccggcggggtttcgcaggctttcccggacctgcaggacccaagggcaacctgggctctaagggcgaactaggctccccgggacccaagggtgagaagggtgaaccgggcagcatcttcagccccgacggcggtgccctgggccctgcccagaaaggagccaagggagagccgggcttccgaggacccccgggcctatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggccccaaaggagaagtgggcccccccggaccaccagggcagtttccgtttgactttcttcagaaggaggctgaaatgaagggggagaagggagaccgaggtgatgcaggacagaaaggcgaaaggggggagcccgggggcggcggtttcttcggctccagcctgcccggggcccccggcgccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttccggggcctccgggcccccctgggccccctgggccccctggaaccatgggcgcctcctcagggcaggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctgggctgcccgagccccagccctaccccggaggcccgcaccacagctcctacgtgcactgcggcccggcacgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcagatggccggagaggaccggcggctcggaggaagcccccaccgtgggcagggagcagccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaaaccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtgctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccagagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaa

SEQ ID NO: 2179 - DNA, 1778 bp, Homo sapiens
  Genbank Accession No. L23808
tagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatctccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggctgtaatgttccccacctacaaatatgtcgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 2180 - DNA, 1058 bp, Homo sapiens
  Genbank Accession No. L25081
gccttgacttcatctcagctccagagcccgccctctcttcctgcagcctgggaacttcagccggctggagcccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccccaaagggcccttttcctacatgccccctcccttcacaggggtacagaaattatccccctacaaccccagcctcctgagggctccatactgaaggctccattttcagttccctcctgcccaggactgcattgttttctagccccgaggtgtggcacgggccctccctcccagcgctctgggagccacgcctatgccctgcccttcctcatgggcccctggggatcttgcccctttgaccttccccaaaggatggtcacacaccagcactttatacacttctggctcacaggaaagtgtctgcagtagggacccagagtcccaggcccctggagttgtttctgcaggggccttgtctctcactgcatttggtcaggggggcatgaataaaggct

SEQ ID NO: 2181 - DNA, 2725 bp, Homo sapiens
  Genbank Accession No. L25444
gatggcgccgagccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 2182 - DNA, 840 bp, Homo sapiens
  Genbank Accession No. L25876
ccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaaatgaaaccaccagtcgttatcaacttgaatgtaaatgtacatgtgcagatattcctaaagtgccttcgtggc

SEQ ID NO: 2183 - DNA, 1704 bp, Homo sapiens
  Genbank Accession No. L25878
cgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaaaattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccattggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactcta

SEQ ID NO: 2184 - DNA, 33795 bp, Homo sapiens
  Genbank Accession No. L25880
gaattcatgcttcatttttaattctttttaaaacagaaaaagtggctgggcaagatggcacacacctgtaatcccagcattttgggaagctgaggtgggtggatcacttgagcccaggagttctgagaccagcctgggcaacaaagtgagacctcgtctctataaagaataaattagctgggagtggtggagcacacctgtaatcccagcactttaggaagctgaggcaggaggatctcttgagcccaagagttcaagaccaccctgggcaacatagcgagaccctgtctcaaataatttttaaaaagaaaaactacctcttcttaagatggttgtagtatgggagatggtgtgtttaagtcttcccaccccagtgtcacagctcagggcttctctagccttcctcacagcggttgggggtgcccagacacatcctgaagtctaggccgtgttctgagtgtctctgccacgggcccgcctggctggctttagtccaggagcagcctggactgtgactcttgaaggctgtgggaggctggtgaccgggagcaggaggtctcagtgcatccctgaagggtcagagagccatgccgtgagaggccaggagcaggcagccattggccctccagccctcaccaaaggccaccacctcagcttgtcctctggcaactcagcctgggaatttgctttccctgtggaacgagagacactggccgcattgaggggtgactttccggtcctacaaaattgtagccctctttctgctagaactggtgagacttggctaatttcggagagactttaggaaagtaagagaaatacattaggtcccagtgccaagccccaaggccatctttccaggtatgggtatatcctgcagtgataagagaagactgactcttaccagctctttgggggaaatgaatatactttcccacgttccagtttttctggctgtggcaggacctgtttgctgccaagttgttcctgtggggaaacagcagtgggcccagcaaatgtagccaccaggtcggggcacagccaccaggtggaagaagcaaccctgccctcttccggttccatgtgtgcctcactgagagcaggacttccagaccctaccaggaagcgctgctatccgggtcatagtgataccctgtcaggacatcgttgtttttgtcttgtttttttttgagacagggtctggctctgttgtccaggctggagtgcagtggcgccatctcagctgtctgcaaactccgccccaccaggctcaagccatcctcagcctcccaagtagctgggattacaggcgtgcaccaccatgcccagctaattttctttttttttttttttttttttgtagagacaaggtttcactgtgttgcccaggctggtcttgaactcctgggctcaagcgatccacctgcctcagcctcccaaagtactgggattacaggcgtgagccacggcacccggtcgagatggaacatcttaatttcagagttgccttcaggactgttgattgaaccccataaatatttttagtcttttgggacttttaaactcctttttgaaacctaagcattgccacaaacaaactaaccttcaccacgaccaaacaacccagaactcggaccctggtcctcgggctgccctacaggaagcacccctagtcctcttgctgctctgctagatgagacagcaggctcaggttcctccatgaggcccggctttcagtgctctcctgttacacactgcaaggaagcttccagatcgtggagcacattgttgaggaaaagacaccttggggagaagggggaggtgcagagtgtggttaatggtgggaaggaactccggtaagtgtgttatatgatctgctcctattatcccctgaataggagcctctctccactcaagagagaatgccaaggactggcccggcatggtggctcatgcctgtaatcccggcactttggagccaaagcagcggatcgcttaacaggagtttgagaccagcctggccaacatggcgaaacccctttcctactaaaaatacaaaaatcagccgggcatggtggtggcaggtgcctgtaatcccaagctactcaggaggctgaggcatgagaattgcttgaatctgggaggtcgaggctgcagtgagctgagattgcaccattgcactccagcctgggcaataaagcaaggctctgtctttaaaattaaaagaaaaaacaagttattctaactttttttaattttaaaagattaaaaaaagagaatgtcaaggactgaaattgcatagagggcaatgctttttctttataggtggtgaactgggttctgcttgagttttttctctggtaatttagaaccaatggaagcaacttcaacagctctaattttaattggcagaatgtgagatggaatgggacctcaaatgaaactccaggccaagagctcatgagccctgcagcatgtggggcatctctcggtcttcttgagttctgtaacttaaagtttgtgtggcctttaaagagtgtggaagtagccgtcccctctccgaaggtgcacaggatttggccagcccacccgcgtggccttccccttcccctctccagaccctccacagcagatggggccacggaggcctggagaagtggagtcactgacctgaggctacatggctggcaggcagcagggccaggcagcaaagcaggcagtgagggcctaactgcccgcgggctggctcggggctccctcaaccacattggcatcccagtgccaatcccaaattgttttctttctatctctccagacatgtagatagcatggaggtggagggaattccctcccacacagagggcgatatgccccagaacagcactcctgcccccaagaaggctgtctcctgacactttttactgctcttttactctcccccagctttttttttcctgcttgtaaactgcatttttcctttcccttggtttctggctctaagctgttttcccagggcttggctccggcgcttgcacagagataaacacggccattggcctggtgcacaatcccagcttgcctgcatccggcctcttccatcctgagtctccaggggtccctggggttcagggacaatggctgagggagaagctgggagttccccccagggtttgcctccgtcactcttgggccagccaagggagtggggctgggagcttcaggatggcttttgggaagcccctgggagccccaaggcttgggtagctgctgacagggagttcacagcaggaacgctcccaggctcccatcctgcgtccgcttggcaggcaggccaggaatgggagggaagccatccgtttttccctttccactggatgttcccttcgccttccccagggagagagtgatgagactggggtgctggggagaggcagtatgggggcaggcttgggaccaggcctgcagaagcagcagaccctccaagcccacctacctctctggcctggcatctgaggggcaggtcatgccatagtttttcccttaccctctctgcccccacactttcctccccaaagtggcagacttcccccaggagaagcactggcttttcacgctgctgtgagtctcagtcactattagagaaacacagtcagagccaggcctgcccaactgtcgcagggctgggtccacctcatggcctttgttctggaaaaatacttgggcattctgccctgcaatgcacttagccaaggccgggcacatggcaagtgctgagtcatggccggctagcactttactgcgattttaggagcactttcttgtggtgaggttctgactgcttgcttgggttgggggaggggagtctttgggcaggcggtagacctgccctttactttgtgtggccggatctgagtctgaccccatctttttagaccccaaaacccctgatatttgtagtgcgcctaggatactggttctcccagtcttctttggggtcagggggcgttatagtgctctcatgccacctactcagcctctcttcctgcatcttatggtctgtctctaccaactaggctaagtaggttatatttattattcctcaagggaattctggtggctaagccttcacctttccaaggagagctatatttatctcttccctgtggtcagctcctgctgatgtagcaaacattagaacttcttcaaaacatcaaagtttaggagacaccatgaaaaactgagaagtaaaacaatacaaaatgagagtgcctgctttattttgctagcacctgaaatcagagcttcattgatctgcctcaaaagttccagagatatattttatctgattcgagtttttgttttgtaatgcacttttccagaatactgacaagttactgggctgagagtttgtgcaggagggggttggaggggaagcctttcagaatgaaatcatttttttctcgaagccaggtactcttcccaacaaaatggttccttgcctagtaaagaaaatacaatttttgttgcaaaccagcatgattttttttaaaaacgtgactggaagatagtggtcatttagctacaagatactgagctcagaggggaacttgatgaacatttggctcctactgtaagaaatgggattgcatacattttaattccaattctacactgaagtcaaattttgggcatgcatttgtgaaaggtggaagaaaatctcactaagttcaaggtgaagaagttagatgagcaatcaatggtctttacccttcaaagatggactaaatgtaaactgttagaaaacaacaaatgatacaagtagagtacttgttagtttacttgtgtttatctttctggatctgaggtataaaggaccattttaaatcaggagagcaaataaagtaggtgctttgttctttggcacagttaaaaggtaaatcacctgtaatcccagcactttgggaggccaacgcaggtagattcttgagcccaggagtttgagaccagcctgggcaacatggcaaaccccatcttcacaaataataaaaaaaattagccaggcatggtggtgcatgcctgaggacccagctactcgggaggctgaagtgggaagattgcttgagcccaggtggttgaggctgcagtgagctatgatcactgcactccagcctgagaggaagaacctgtctcaaaaaaaaaaaaaaaaaaaaaaagaaccaaaaaatgaaaaacaggctgggtatggtggctcacacctgtaatcccagcactttgggaggccaaggcgagcagatcactttaggtcaggagttcgtgaccagcctggccaacatggtgaaaccccgtctctactaaaaacacaaaaattagcatgggtgtggtagtgtgcacttgtagtcccagctactcgggaggctgaggcagaagaatcgcttgaacctgggtaggcggaggttgcagtgagccgagattgccccactagactccagcctgggcaacagagcaagactccatctcaaaaaaaaaagaaaaggtagatcagtttaataatttaatggaacttaatatttgttacactggggtaaaaataaaagtttgctttttaaaaattctcttaagtgatgtcactaagtcaagttttaaaacatacaattcattttaagattgatacttaaagttcaaatgaactctttttctgttatttgaatgtggtttttaaagtgccaagaagttatttgttttttaaagtaaataagagatttggattggcgccttggaaaagcaagtataaacatgtttttggaccagaggttggttcagcaacactgagtgtaactactggctgggtactgtgcaggcaccaggactaacacacaaccctgtaactgtaggagctcacactttagcagggcagacaaacggataacagataaacacccttccagttatagacacatactatatgcacacagatggaagaagaagtgtgcacaagcagaagtggttaggttttgccacaaagttttcacagagaaggggtcattgagcagggtttttaagtatgaataggagtttaccaggagaaaaataatggtggaatgggaataatccaggcagaaagaagagcatgtggaatggaatgggatggaagtgaggaagcgcatggcatgaatgaaaaaacacaagagtctcataggctattttcgcataagagttgatgattccacatttccgagtgtagttgtctcatttattactatactatctcttttataaattgctacttcatcacgagctgacccaggagttttaacttagaaatcgtgtttacaattcagattacccttctgtaaattacatgctgaaaagagtgagctaagaaaatatacttggggacaggcgtggtggctcatgcttgtaatcccagcactttggaggccaaggtgggcagatcacctgaggtcaggagttcaagaccagcctggccaacatggtgaaactccgtctctactaaaaatacaaaaattagccgggcatgcctgtaatcccagctactcaggaggctgaggcagggagaattgcttgaacccaggaggcggaggttgcagtgagccaagatcacaccactgcattccagccttggggacacagcaagactctgtctcaaaaaaacaaaaaaaagaaagaaagaaaatatacttgggaatgtgaggattttgtggttgagtgaagaaaggtggcccagacaggagattactcagaactcaaaggttcaccgcagctgtccttgatgagctggtggctgcggcaaatacgccatcagattgggatgttgaggcagactgctagcaatgttctctccttcttccttagcaaaggatttttaattttagttggagaagaccagccaaacacttgacatttcttggccccctggcagctaagtatgacagagtgattaagtgcggacaaagagttataaatgtattagagcagagccacctggggcccagacagtaccttgtgtcaaaattttctccagtgcatctgaaatcgcactgtgatcctgtccccctaaactttgtcttctcttggtgttccctccctcagtaactgacattacccgccctgctactgccatagccaaaaacccaggcaacgtccttgttaaacccctctccttcactccgccacagatatcagaagttctggcagctgaacttccaaagtacatctcaaatccatctccaacccagcccaggttcctgggctctcccctggactactaccctgcccggtccactcacatctgctctaccccttccaacacaatggccactctgaagccacagcaatctttttaaaacattttttttttttttagatggagtctctctctgtccccaggctggagtgcagtggcacgatctcggctcactgcaacctccgccctggttcaagcaagtctcctgcctcagtctcctgagtagcggggactacaggcgcatgccaccatgcccagataatttttgtatttttagcagagatggggtttcaccatattggccaggatggtctcaatctcctgacctcgtgatccgcccacctccgcctcccaaagtgctgggattacaggcgtgagcccaccaatacaaacctttttttttttttttttttttaatggagacaggttctcactatattgcccaggctggtctcaaactcctgggctcaagtgatcctcctgctttagcctcccaaatagctggattacaggcatgagccaggccagagtgatcttttggaaatgcaaatctgatcatgtatatcccatcccctgcgaaacccttaaagagcttcccattgtccttgggttagtgtggccttcaaggcctgtgtgatctcaccactcccctagcccctcagagtgctactggtatcaatattatggagaaacagtttacttgaaagctaagtgagagttttagggctgggatctcacgctgccccccgatctttcagttttgtgctcaccatgctgtcttactgtggggctttatgaaggcgaatccctctgtcgaaaagctattccctccccttcccacctccctaacttctatccacctttcagatttcagactgactgtccctcctctgggtagcctctcctgacctatcccagcaaggcagatctctcagtcctagcctttgtcgagctcacatttgtcagggtgattatgtgactgacagctggacggaagctcctgtaggccactgaccatgtctgctttggctcccatctggactctcagtgcctggcattctagtagaagcttaattatttgttgaatgaatgaatgaatttaaaaattctttgaatgagagcatagaaaattaatcagaacttttgaacaagaagagctgaattctgccccttgatgctgagaatgcaccttctccgaacagatggaaaagaggggtggagattaccccagggacatatcttgcaaaatgctgatacccgaagatgtacatagccttgtgctttggtcatcctcccaaatcatgtccttggtgaaggcacatggagaggagagcagatgctgccagaccacggtgcctgacgccatgcactccctcacgtccagcctgtttatgtgcacacggctgcagcgggaccttggggtgtgggctaaataacaagaacaggggctcctctggggtctgttacaaggcagagatgctccacggtaattagggatttaggggaagaggaaggaacacacatgttgataataagtagttcaacattattatccccattttacagatgcagctactgagcttagagaggtttcataacttgcccagagcccctcaactagtaaacagtggagccgagatttgaacgacccaaagaggaaagcaaacaagcagcccctttattactttttttttttttaagatgagggtcttgctatgttgcccaggctgatattgaattcctggccacaagtgattcaccaccttggccccacgaagtactgggattacagtcatgagctaccacactgggccaaagccctcgtattgtaacctccaagatgttttcatttctaaagtcaaaggttgtcagagttgctgttttgcagggagccatgggatggggagtctccgggaaacccaggctggctccttaaatggcatcacccaagttggccatcaagcttccccagactcagtcactcggccccctctttccctggctgtagagcaggggtttggactcgaggctgctgagttcctctccagcttccatgcccagtggcagtgacttatcaactggcccacccggtggatgtaggggtgatgcagccctgctctgtcctcttgagtgctgggtggccatgagagagggaggccatgagagggaggggagggttctcatctgcttagtgccaccccctccccagcccaccccaggtcctctgccgccttgggttcctgcgtgagcagtccttctcactctgggcgatgttcgctttcaccagcccaaccccaagaagtccaccctggggaggacagagggggtctccacggctccacacccccatgctttgtcggagatctggccaggcagagtggtgccctcttgactgagcctcgagcctttgctttccccttactccaaataaagccgcagccctggcgagggagcccagaggcctgaggacagcctgctgggtgcctggcactctctagatcctccctgcctgggcggtgggcatctgcaattctccctgtctcgaactgcagcagaatgtgtgggcagggttaggcagatagagagtgggtgcctggactcattggtcagactctaagaccgcccaccgcccgccgcccccgcagtccttcccaggactggctgacccaccagataggggagggtgttgtttcttattattacattttttgagaaaagctatgcaggcctgggagacgtctgtgccctaggagtcccttctggcctgaagactcaaggctgcaaacaggtgctgagagggaacaagaaggggagttggggtgcaacacacccagtgacagaccaggagtgagtgctgtggccacagattctaatcctcacaactgcagtgtgatttaggctaagccccttgcctactccgattcttgccttaaataagtgaaaaggaaagtcaagtttgatgagttgtggctctttagtgggtggatttgcatgtaccatggattacatttaccagggtctaggaattgtcaagcgcccagcaggctgccatcaggcctctgagctccttcgccaggcggctttatttggagtaagaggaaagcaaaggtttgaggctcagtcaagagggcgccactctgcctggctagctctccgacaaagcagacgggggggtgtggagccgtggtgaccccctccgtcctccccagggtgggctccttgggcttgggctggtggaagtgaatattgcctgcagcaagaagaaggactgttcatgtgggagcgcaaggcggcagcggggttggaaacccacccccacacagtcaacacctgctgtcacaccaggctaatcaagaacacctttctttggtgcattaaccacctgctattaaataaaaggctgttactaggtggcaaagtaacacactgcagtagagcctatttgtaatctgagatcagtggctgtaaggcaccatccttgagccaagcaagtactaatattcttgttatcttaattagaatgcaagagatcgtgtttttaaaattctctttgaatctgtcactttgccctcctcttcctgggtgatacacctggtagtgctggtgggggccatcataatgccccttgtcccagattcccttcttttagatgggactcgagcactgatcatttcagccctgtatctctcaggtcagcgtggttcagtttgctgtgcagagtccaggggagataaccacgctgtgcacacatgagattggctgacttggcaggactgtgcaattgtcagaaggccgtggggagtgggggccagtgcctgcagcctgccctgcctctctcacaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggtaaggagggtggtttgtaaagttcactggggagggtgatccctctttattgttctaatattatgctcgcagcctccttgacaacatcatgcaaaatgtgtcttactagtttctagtgcataaaatattggtggagctcttcgctgtgctgggccagtcaccagtgctgggcactgtgggtcaagcatggcccaggacggacagccctgccttcccaagctatggtttattgtggtaggatctgcctgcccagtgaagtgtgttcagctgctcctgttgctgggggaagctctgctctctgccttcggctgcctcccacacgctcccatgtgtctcccagtccctaacccctagtcctgctttcaataccgcaggggcttttagctgacttttctccatcttcttaaagggcaggatttcctggcagagacataacgtctttctggaaatgaaagaagctgatgcatgtttttcttttctgaattacttaaataagaggaactcatttccaggtattccctgccttgtttttattgtgggagtgtggtcccagctgcccatctgatcagctgacatagggtccttggggcccaggcactgttctgcttgggattgaaagatgaaagccacagggccaggcacagcagctcgtgcctctaatctcatcactttggaaagccgaggtgggcggatcgctggaggtcaggggtttgagaccagcctggccaacatggtgaaacgctgtctttactaaaaatacaaaaattgcaggaggtggtggtatgcacctgtaatcacagctactcaggagtctgaggcacgagaatctcttgaacccagggacagaagttgcagtgagccgagatcgcaccactgcactctttgagactctgtctcaaaaaaaaaaaaaaaaaaaaaaagggaaagcaatggcctggcttggctggagatggaacatgcatcaacgtgtcccacgtgtctccagcagggatagcgaaggcctgccccctggcacatagactgagtaaatgttgatcagtgagaccttgaggcactttagagtttcacaatccagagagggagatagattggaagttcaagggtggacacctgggcatgattcccaggacgaaggctgcagtcggttctaagaagtatgctggtgactatgagagaagaggttgtgggtttcctctcttgaaagctgtctccataatcacatgtgggggtgataagggctctggtccaggggagggggcgaggcacacagggggctgaatctgatggcatgaggacttggtgatgggctgtggggaaagaattggagatgactctagggcctgagggtgggaagctgggagttcactgggatcactgatagaaacgcggaggtggggggtgccaagctgattttcctgattagatttcctacagaactgcaggaataaggcgagagccatcgccctgggtggatttctgtttggagctctatcgctggaccactgtggacaagtatttcatagaacgacccccagtagcccaattctaggtttagaggggcagctcttgacaggagcaaactccagggcctctgcaaccccccagcagagtcccaaacatctgacatgtagccaatggaggacatgcaagtggtggggttcccagcagggaccacctcctgccttgggtttccaagacagagcgaggggtgctgctggggcgtggtttgcaggggccttgtcagaactcgatgctttctcctccgtctgggtcctaactgcagtgcatctagagaccctcctctgactcaggcataaggacggcccgatattcatgcaggttactctgaacaagaacagtctgtgggttacttccctaggaatgaggaagatgaagagctagataacaatgctgggctggtatctgcctgatagtgctttgccaagactatggtttcttcctcttctgatcaaaaaagacacaggagtcagacaaatggggattaaaagacaactgagttgatgtgaaatgtaacaggcaacactatggacacagaaagtagattagaggctgcttaggacctaacgtggagggcagtaggggagtgacagctgaagggtatggagtttctccgtgccgatgaaaaatgttctacagttgactgtggctatggctgcacatgtctgtgatatcctagaaaccactggagggttcactttaaatgggcgaattgtatggtatatgaattatgtttcaataaagctcttaccagctaagctgtgtggccatggctgggcttcctagcagtgtcccccaaccccaaattgaacttactctcccagcacttgggcctccccattaccccctgtctgccctgaggataagcctctctccaagaaggacagagcaggggctgtgggccaccattcaggaaaggtgctcctctcccctgggggagggaacccagaggtcatggacagaagccttctcagacatgcaaaaaacatgaggctgtcgggcgccgtggctcacacctgtaatcccagcactttgggaggccgaggcgggcggatcacgaggtcaagagattgagaccatcctggctaacatggtgaaaccccatctctactaaaaatacaaaaattagctgggtgtggtggcacgtgcctgtagtcccagctactcgggaggctgaggcaggagaatggtgggaacctgggaggcaaaggttgcaatgagctgagattgtgccactgcactccagcctggtgacacagtgaaactccatctcaaaaaaaaaaacaacatgaggcctcagaaatgtagctcccaaaaccccctacccagggctgtgcagaagccaaaccaggttcctattttcccaggatgatgaacagttttcaaagcttagtaggattgtgggtgattttgtctcattgtctgttgtttttccatttttctagatcatatatatataatatttatactatatataatatgtatatagtgtgtgtatatatatatataatatgtatatattaggtcaagtgtaaataaaatcagggacagggttggagtcgtcagcaggaaagagcctgctggggatcagagtctctgggctgtcagggctcgggctgggctgggctctcgttgttaatggtcttcccctcatcttgcaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgtaaggcaccttgggccgggccgggctgggcagtggagagggtggtgtgtcgaagacaggggttgggtcttaggccagatgcgggaggggacgggggcttgggaatggtccatcctacttgggagtgtgtttcagtctgcttttcctctgctgggcaggtgcaggttgctttggagagggatgcccagccctcccactttctctcttctcctttccctacccaaggcccagcagtgctcaggcaggagatggggtaacctgtatcaaaggtcacagaaagcagctgtcatcacctcctctatgccctgcctgaagccttgggagtgaggttgtgggagaaagtgagcaggttcccgtcagagacccaggaagcactgagaaggcagggatgctactggttaggcaccggctgtgtgtcagccattcctggtcacattcaatcctacggtgatccgcggggtgaggattgttgttcccaaactgcagatgcagaagctgaagctcaggggcataaagcaactcgttccaaggcggcctagctaacatgcggaaggatttgaagtccaatctaatcctgaagctgctgcccctcctctgcacagggatagagtcaggaaggaggtgactgggcaggtggggtgaactgagaatgcattctcggggaggagcaaggcttgagtgggggacaggacggtagcagcctgcatgccctgccaatcctttctttcattccgtgggttttgagcacctactgtgtgcaggcccagtgagtgcttgggagaagagacagccccttccgtccaacagcatacagtccagtgaatgagaaaaggaatgtgcacaaagaaaagtagactaaaagataaataaagataggctaggtgcggtgcgtcacgcttttaatcccagcactttaggaggctgaggcggtggatcacctgaggtcaggagttcaagaccagcctggccaacatcgtgaaaccccgtctctactaaaaatacaaaaaattagccgggcatagtggcgggcacctataataatcccagctactcgggaggctgaggcaggagaatcccttgaacccaggaggcagaggctgcagtgagccaagatcacaccactgcactccagcctgggcaccaagagtgaaatgccatctcaaaaaaagaaacagatgcataaggataaatgtcacaaaaagcatggataaaagtcatgagagttccaaggaggaagagatttaaaagcagaagctgggctaaacccaagagcaaccaggctgaggctccctgggtaggacttgcttgctgcagccttgctatttagggccaagctgagccctaaggaaagctcctttagggaattagactcctaagggagtctgagatttccaaaatctgtttgggggtaactgaaacacttgggaagaagcctgggaatggtgatgcttgagaggctctctaagctgacatgaacttcctcctctggggctggccttttagcctgatacatgtcaatgagacttgcaccctctctcctggtctgtaaattttttagtttttggagacagggtcttgctctgtcaccaggctgggggtgcagtggtgcgatcttggctcactgcaacctccgcctcctgggttcaagcgattctcctgcctcagcctcccaagtagctggcattacaggcacctgtcaccatgcctggctaatttttgtattttttagtagagatggggtttcgccatgttggccaggctggtctcgaactcctgacttcaagtgatccacctgccttggcctcccaaagcactgggattacaggcgtgaaccaccgtgctgggcctggcctgtaatttttatcccaactcagttataatgtatcattcaatgttgtatatcaggggtcaggaaaccaggcccatagaccaaatgtagcctgctacctgttttagcacagcgcccatgccaagaatagtgtttacctctttaaatagttagggggaaaaaaatcaaaagaagaataatagtttgtgacgtgaaaattatatagcagtcagatttcagtgtccataaatttttattggaacacagccacccccattcatctgtgcattggctatggctgtccataaataaagttttattggaacacagccacccccattcatctgtgcattggctgtggctgctttcacactatgaagacagagtggagtcactgcagcctgcaaagcctagaatatttactatctggccctttacagaaaaagtttgccgactcccgctgtgagaacgcctgggtaaattaaagatgagtatcgtgtatacacttaaagagtaaaagatgagctgggcgcagtggcttacacctgtaatcccaccactttgggaggccaaggcagacagatcacttgaagccaggagttcaagaccagcctggccaacatggcaaaaccccgtctctactaaaaatgcaaaaattagccggacatggtggctcacacctgtaatcccagctactctgggagctgaggcatgactggcttgaacctgggaggtgggggttgcagtgggccgagatcacgccactgccctccagcctggggccagagtccggagaccctatctcaaaaaaaaaaaaaagaaaaaaagaaatgcgaagtctacagtgaagaaggaagaagtgaagaacacatccgctttggagtagccagtgatgtgggaaactgccttgccacttccagagggcagtatcttgtggctgcagggtttgctgtgttttctggaaacagactttgctcttgtgctctgtccttcccatccctctcaacttggggtcctgaattttgctccaggacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaaggtatgtttgcaaaacgccagccagagagggatgtatgtcatgagaacagccttcttccacaatgtgacttacagtcagataaagttggagagattcagaacccaattataggtcactgagatgtacttatacttgtaaccttactaaatgcaaaaatattgcagtcacaacaaatctgtccatctttagagctaggcaggaacacatacatgcaatttaaaaaccaaagaaatgcaccatccagtccaatgatgtggcaatctttgagaggaaggatggagatgagatttagacccaggccaagtgggggtggctcagaactgtaatcccagcactttgggaggctgaggtgggtagatcacgaggtcaagagttcaagcagcctggccaagatggtgaaatcccatctctactagaaatacaaaaaatagccaaggtgtgttggcaggcagctgtaatcccagctactctggaggctgaagcagagaattgcttgaagccaggaggcgaggttgcagtgagccaagatcgcgccactgcactccagcctgggctccatctcaaagaaagaaaagactctgctctcagttcttttggatctatactcagaagtggacttgttggatcatacggtaattctgcgtttaattttctgaggaaccgccatactgcgttccgcaggctagctgcaccattttactttcccacccaacaatgcctcagaatcccgattctccaaatccttgccaatatttttttcctttctttttttcggtaatggtcatcctaatgggtatgaaatggtatcacattgtggttttgagttgcattttcctaatgattactgatgttgagcattttttatgcggtacttattggattctttgtaatttctccgaagaaatgtctgttcatgtcttttgtccattttttgggtgttttattagggtttaggagttctctatatattctgaataaaatctcttatatttgcaaatgttttctcccactctgtgggttgccatacaattaatctttttcagagacaaggtcttgctgtgttgctcaggctggagtgcagcggctattcacaggcgtgatcatggctcaccacagcctcgaactcctgggctcaagcaatcctctcgcctcagacctcctgaatagctggtactataggcgagcaccactgtgcccagcttgttaattttttatattgaagaaattgtacatgttaggaatcttatttttaatgttttaagataatttggccttttcaaggaacagtgaagattttaatttgttaaaattctaggaattacttaaagtatatgaaagacatgttggtcagtcagataaactaaagttcctaaaaaaaggaaattgaaattatagtgttaactgggtgtggtggcatgcacctgtagtcccagctactcaggagactgaggcaggaggattgcttgagcccaggaattcaaggctgcagtgagctacaaggacaccactgcactgggtgacagatcaagaccccatctcttaaaaaaagagagagaggctgggcacggtggcgcacgcctgtaatcccagcactttgggaggctgaggcaggtggatcacgaggtcaggaggttgagaccatcgtagctaacacggtgaaatcctgtctctaataaaaatacaaaaaattagccaggtgtggtggcgggtgcctgtagtcccagctactcgggaggatgaggcaggagaatggcgtgaacccaggagatggagcttgtggtgagctgagatcacaccactgcactccagcctgggcgacagaatgagactctgtctttaaaaaaaaaaaaaaaaaacaggctgggcgccgtggctcacgcctgtaatcccagcactttgggaggtcaaggcgggcagatcacgaggtcaggagatcgagaccatcctggtctaacttggtgaaaccccgtctctactaaaaatacaaaaaattagccgggcgtggtggcaggcgcctgtggtcccagctacttgggaggctgaggcagaagaatgccgtgaacccggaaggcggagcttgcagtgagcccagattgcgccactgcactccagcctgggtgacagggcaagactctgtctcaaaaaaaaaaaaaaagaaaaaaaaaaaaaaagccgggtgcggtggctcacacctgtaatcctagcactgtgggaggccgaggcgggtggatcccaaggtcaagagatcgagaccatcctggccaacatggtgaaaccccgtctctactaaaaatacaaaaattagctgggcgtggtggcacgtgcctgtagttccagctactcgggaggctgaggcaaaagaattgcttgaaccagggaggcggaggttgcagtgagccgagatcgcgccactgcactccagcctggcaacagagcaagactccatctcaaaaaaaaagggagaaaggaaggatggacggaaacctcgacttggaggtgccagggcagcaaacatccttgttctgatgcaagcaggccaggcctgtgggagaatgagccagagaaaagctaagtcaaatcccagtggtgtgtgtcctggaactagagcccatcctggagctcagccaagaacactaaaaaaaaaaaaaaaaaaaaaaatctggaatgattttttggatcaaatttggacttctcttgagtgttgctgtattctttacagtaatttgatatcttctattatgagcctaacaagaggatccaagccacttaatcccagccaaactgctgtatgcaattaccataggttcctgtttggattcctggcacgaaattgcctggcttccttgagtttgacttggatccctgtgttgtcccagctcttcagtgtccatccagcagaaactaacagggcgcctgctgtacccaggcattctgctggggctggggacgcatagagaggacagggtccctccttcacagctcataggctcttcaggggcaattccagcacatagtggcggtgttctgaaggaggaggctctgggagcttcatgagccccacaatcttcctttgaatgtgagggaaggcttcctggaggaggtggcatctaagctgaaatgagtgggactttgccaggtgtgtggggaaggtggtccaagaaaggggaacagcatgttcaaaggcccagaggcaggaggcagtaaagggccctttccatcctgcagctgccagccttaccccactggaccctttcagggttcttcatgagactgggttttttttagagacagggtctcactctgtcagccaggctggagtgcagtggtgtgatcacagttcattgcagcctcaatttcctgagctcaagcgatcctcccacctcagcctctcaagtagctgggaccacaggtatgcaccaccacactaggcctttttttttttttttttttttcttgagacggagctcgctctgtcacccaggctggagtgcagtgacgcaatctcgactcactgcaagctccgcctcccaggttcacgccattctcctgcctcagcctcccgagtagctgggactacaggcgcccgccaccatgcccagctaattttttgtatttttagtagagacggggtttcaccgtgttagccaggatgatcttgatcgcctgacctcgtgatccacctgcctcagcctcccaaagtgctgggattacaggtatgagccacggcacccggcctttgttttttctttcctttttttttttttttacatttttagtagagacaaggtctcaccatgtcacccaggctgatcgcaaactcctgggctcaagcaattctcccaccttggcttcccaaagtatcaggattataggtgtgagccaccacacccagctgacattgggcatttatggtacaaaacctccctcaggtacaacgctccaaaagagccagtttccagcattgaattcatcgtggacttacccatgtgtggttctggcaccctgcccggggctggaggctgttcttggccttggtcctttagaataggagtaaatttggcaacataggaggacacccaggatacattgttaagttaaaaaaaaagagattctaaaatagaatgtatgtatggttctatttttgttaaaagttatgttctctaagtctttttaaaaagtttgaactgtcacagccaagaagggtctaaagagacatgacagctcagtggtgtgtgagtcctggatgggatcctggaacagaaaatggatatcaggggaaaaactgaggaaatctggctcatattttgttgtgtgtagataccagcattatccaggttttaaaaaggagaaaatcctggccgggtgtggtggctcacgccagtaatcccaacactttgagaggccaaggtgggaggatggcttgagccagtagtttgagaccagcctgggcaacatagcgagaccccttctctacaaaaaaaaataacaaaaataggctagacatggtgttgcccacctgtagtcccagctacttgagaggctgaggtgggaggatcacttgagcctgggaggttgaggctgcagtgagccgtgattgtgccactgcacttcagcctgggcaacacagtgagacctcatctctaaaagaagaagaaaaaaaaaggaaatcctgcaatgtgtgacaacatgaataaactctgaggaaataatgctaagtgaagtaagccagggacaggacaaataccgcatgattccacctatagaaggaatctgaaatagtcaaactcagcagaagcagagaggagaagggtggttgtcaggggctggggaataggggaaacggcattgctgatcgttgctgtgtaaagtttgagtcctgccagccgaatacatcctagagatgggctgtacagcagagcgccgtcagtgttggacacttacaatctgttaaaagggtaggacccatattaagtgttctcgccatataataaaaagtgtaaacactaaggaaatcaatggactttatagttaataatatctcagtctggttcgttaattgtaataaatgtaccatgctaacataaaatattaataatggaggaaacccggtgggtgtgaggtatatgggagttttctggactctttgcagtttttcagcaatctaaaactgttccaaaataaagtttagacagacaacaccatgttttctttagagagtgggattacatgtgagtcttccccctttggcttatctgtgttttctaagttttctacagtaaacatgtattatttgtataatatattaacgacagaacagaacattagctagaccatgctgactgcaccagccctggtggcagagagttccaagcatggcagccgccctcactgtgaatgccgtaaggccccaggtgctgtccagggcactggcctgggaaggggctgccttcttttgatatgcagaggccccaagtcagtccagaggagacaagaatccattcacctgcccttggctatgatgatgttttcagcattgcacttaaaaaaaaatcttccactttattttattttaattttttgagatggagtcttgctctgttgcccaggctggagtgtggtggtgtgatctcggctcagtgcaacctctgcttcccaggttcaagcgattctcttgcctcagcctcccgagtagctggaattgcaggcgcctgtcagcatgcccgggtaatttttttgtatttttagtagagacggggtttcaccatgttggccaggctggtcttgagctcctgaccttaggtgatccacccgcctcagccttccaaagtgctgggattacaggcgtgacgaccacaccaggcccaaaaatcctccactttaaagaaaatatcatttggtaatcagaaaaaggtgacattttgtcaatgtgtatgaaaaaaattatgcatttaatacctgttcattgtagaaaaattggaaagtacataaaactcaaagagaaattaaaagcactggaatctactgctcaggaaaactgctttttacattcttggagtttatcctcccagacttttaaaattcaccaatacatggtataagtacagtataagcatagatgactttttataaaaactgggtcacacaatggatatgacttgatcatttgcttttacctcccagcaatatcttctgatcagttttctatgttaaataaatatacatctaccttgtcagtttagatgactgtactggactccagtatactgtcaaactatacttgattaatcctgtattgctggatacgtggggctttctccctaccctccagattttaaattattgaacaagtatttatggaggcctgctgtgagccaggagctgtcctgagccctggaaacccagcagtggctgtacagacctggcccagctgtcagggggcacctctaaggaaaccgggaggcaataatcgtagctcccttgcagggaggttgtgaaggctgagtgaggacatctgtgcacctggagcacagtgtgagtgtgaaaccagtgtcagcccttattactgtcaataccatgaaggggcggcgggggcactaagggtggcaggactcaatatctaggctctggggggtgccagagcctgaccgtgcagggtcttctctctccctccaccctgactgtgctctgtccccccagggctggacatccacttcatccacgtgaagcccccccagctgcccgcaggccgtaccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaagggtacggggctgctagaggttccataactgccccgtcctcgccaagggtgggcccggtgttcccaccaggctctccttccggcggggtgagcagggagttggcccgaggaagctgggaaaggaggggcctgagaggccggccccagacacaccgccctccgggctggagatgccacccctatatttgggctccaggattccttcttgcctctgtgagcttttctgacctccacctgggggtaggcgggtcctgagaaatttcatagaacaccagagggcccaaggagcaatctgcctgtgactccgtgactccatgcctttccccatcactgccagggttcaactcggtggccaccgccaggatcttttacaagctgatgctgcggctgggcttccaggaattctacattcaaggaggggactgggggtccctgatctgcactaatatggcccagctggtgcccaggtgaggtcactgttggggtggtgtgtgtgtgtgtgtgtgtgtgtgtgtgtgtgtgtgtgtcctctaagaagtggacctgtgtgcagggtgggccaaggacccccaggggagaggagggagtgtgacctgtcactcagcagtgcctgaggcatgttgacttggatcctcctgtctgtaacccagggttgcggctctgggtcaggttcccaggcagagaaggcctgtgataggaggggaaggtcaggcattagacctctctgctgaccaagctctgggatagccctgagcagaactccccagaaactgtatttttcccccaacctcccttctccaactcccatgcctccagtggggccagtgctgaaagaggctggctctgtgctcgctcctcagccctgaggcctgttcctccgccatctctcctctctccctgtccttgacaccagcccagcctcaccccggcccctctctctgccttcagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggtgagtgtgctcaggggtcctcgcccactgccggctccactggggcagggagacaccgcggggtaacctcaccaccccaccccaatgctgcccacagaaggaagcctcttgtaaggacctcccagctctttagatctttaaactgcattttcccatagaatcaagaggatggaccctcagcagattcccaggccaatttagcaactctgtttagccgactcagtattcatagtggctttcacccctgatctcccacccctgagtctatatcctacactgagaagcagagggatggagggggtgaggtaggaggaatcctgggagtgggcagctctggggctgcaggggagaggggagagggtgccctggggccttggggaagaggttcccaggcagtgagggagggcccagcaaccatgtctgccaccagggtcctgttaaaggacaatactttttcaaaaaggtaaatttataaaggaaccagtaaaattttaaaaagaaacaattcaaagacaaataagaacactgaaattaatttgctaacagacacaaaacttgtcaacatccacagagtaatatcaattaaatctccatgggacaaaattcatttgcctctatgaacaagagtcattcgcattaccctcagttctttacaattcacagaactgtaaaatagctcaatgacaaggaaagatgggacccctgtagcatcacgtcagtccggaaggtctgctaggtaactccctagatcttgtccagaagacacccaggaattgtcttgcccatctcaaagttcttcatagttttcatggcaaacccatgcccacacacacgaggcagctcataatcataataatggcactttataaaagtcagcatttttctctgattataaaatacatgttgtcaaaaagcttaaaaatgcaaaaagtacaaaacattaaagacaatctcatataacctcttctccctccccacatcccctctccttcaaaagaacttgtgaacattttggtgagaattttcacaagtgaagtacgtccatctcaccaacatggccccaacactccagatgccctcggggttctctcccaggtaccacgctctgacttctgactgagatggttttgattgtgcctgtttaagtcctatgaatagaatcacagagtatatacccttgagtctggcttcttttgctcaatattatgtttgtgagattcatttatgccattgtcccagctttatttatttattttttctcaagacccagtctggctctgttgcccagggtagagtgcagtggtgtgatctcagctcactgcaacctccgcctcccaggttcaagcaattctcctgcctcagcctcccaagtagctgggattacagcacctgccaccatgcctggctaatgttttgtatttttagtagagacggggttttaccatgttggccaggctggtctcgaactcctgacctcaggtgatccacccgcctcggcctcccaaagtgctgggattacaggtgtgagccaccgcacccagcctgtcccactgtcccagccttttttttttttttttttgagacagagtcttgctctgttgcccaggctagagtgcagtggtacgatctcggctcactgcaacctccactcccgggttcaagcaatttgcctgcctcagcctcccaagtagctgggattacaggcatgcaccaccatgccctgctaatttttttgtatttttaatagagatggggtttcaccatgtcagccaggatagtctcgaactccttaccgcaggtgatccacctttctcgccctcccaaagtgctgggattacaggcatgagccaatgcccccagcctgttccagccatttttaatgactggacagtattttggcttaggagtatatcaatatttgtaactgatcccctattttagacttttttaggtggcttctcatttttcatgaatcagagcacatagactgaaaaaccccgcctttttaaaaacagcacttctcattgggaccccaccaaatgcagagcgtaggcccttcagtttgaaggaagctgagcagcagtgtgccaggccctgggagacagtgggaaggtatcgtccctgtttatcagatgaggatgccgaggcagagttaaggaagcgaggcatgtgagcacccaggagttaaggcaggcctgtgctcgaacgtggcttcctgcacacagcccgccctctgcggccagtgccacacatcacacctgaagctccagctctctggtccccaggcctgagtctctcccttgctccccgctcccgccaggctctgctctgaatgactctcctgtgggtctggctgcctatattctagagaagttttccacctggaccaatacggaattccgatacctggaggatggaggcctggaaaggtgaggccctggtttgccccctgcagtcatgaccctggtcccagcagccaacctcctcaccctcttcatcccccttgtctggttgctctgcatgggggcactcagcaaattctattgttggctttcttacaaatcctcaccctgtgaccaacgtagctgcattttttgggtgaggtggcctggttgggttgttcccagcctcacagtgcatggtcaagactaggatgcaggctcacctgcttgtgctccttttgctgaacaggcctctggggattagggagcccacagcgagcaggcaccacattattgtcaagagcacctgggcttttcctcctgattccctggaagagcctggcatcagggtcacgtgactgcgtgttccaggagggtggtcgcagaaagacaggaggctgttaatctctcagagccttagaggctgtatcctctacatgcctgactccccagctctgtggcctgactcaggcttcaccaaggtcagctctgacccacctttccagggcccatccctttattccttcagtgacacacaggaccagacagtgctggggatgggaaagacagtaaaatgagactgaatcctgccttgggggtagggactctgtcttggccatgctgtagccccatcacctagaacaatgccgggtgaacagtgggagagcccagtacatagatgttgaatgaatgcgcaaaggactgtgagagtccagtggaaggaggattctttgtctaagcggcagagaggggaaatgaccaggagaatgtatctgatttgggccttggaggataagtaggagtttgctggatggaggagagaaacttaggcaaagagaaaagcaataaaaatgcaaggaaagggtgcttggaaagggtggcttgtccagaggctgaagcaggtacactggggccagatcaaaagcaaactcattctgcaggcaggtcctcacctcctccaagagcctcagcagggccttcgtctgggatctgtttcccctgccctacattcagcaggacacaggggttgatggagcttctgcaagaccaccttggcagggggtctggcctgctccttgcacacggatacctggagcaagatgtgaggccccaccagactatcccactaggccactcctgcagctctggccccgggttacagggagcaccaaatccctgagcaggaggtagacaggatcagatctgtgttctagaaagaacaggaatacactagggtggaaatggtggtcgtggtcgttttcaagctgcggcagagccgaaagggagatggaagcacttggccaacttgcagaaatccagttcacagaggtgatgtgtatactggaactagttttcattgaccagttttcattttgccaccaaaatcacattgaaaaggctgttccctttatctctgtccctgctccctgctgctgttgctagagattcagggtttgagtgaggaaggtagggttgggagggcgtgctctggggaaagtggaaggtggggtgggggctgtggagtatgcatcctggacccaagctggctaggtttggattctccacttaataagtaaaaatggagataatagtacctatgtcccataggctgttgagaggaaaacatgaattaaaaagaaggtaaggagcttagaacatgctgcctggtatgtggtcaccacagtagctggtgccctgagcagtttcacggtgcaggggttgaggggagggaggagaggtcagtggcaggagagaggggacaggtgtgtagaggcaaggtgggtggggggaggaccttggggtgataagagacacttcaactaaatccatgcgctccagtctagtgccctggcgcagcctgcctgtgacacgaggataccacacacgttgcatgaggtctgaggagggaagccgcatgggcagggcctggcatttgtaggactttctggctgccctttgtcacacaactgcatgtggcactgagagtggggctttgtgttctgcgttcccaggaagttctccctggacgacctgctgaccaatgtcatgctctactggacaacaggcaccatcatctcctcccagcgcttctacaaggagaacctgggacagggctggatgacccagaagcatgagcggtgagcctggctgagccgagaacaggggcctctgaggctggaggcagggggacggccagtcttgggctccacgaagggcacttggtggtgggataagtatagccttgcctgcaggtgccccagggcccttggatgggaacactaaaggtcgaggtgtttggagaaagccctcatggagggaccaggtgcctggctcccgggcggccctcagtaccgctccccagtctaggatgctggtctggagtggcactgatggttctgggatttccaagtctcacatggaaaccctcaaaggtggggatttagaggctgtcccatgccccctgcctgggtggccctcccagaaaagagaaggccctcagtgaggggagagcggttgagaccctggatttgtccttttctttatggctccttgtgggtgggccagctgatctcacccccaggcgctttaaccccctgctgtgcagacggaggggcgcagggccacagcctcacccctccgtcggctctttcacttccaggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatgggccccctgtgcaagcagagctggccggccccctccttgctggcagaggcacgggaggcctgctggggatgaggccactggccagggctatgctgcaccagaccaatggcaccgccccacccctcccagcgcaggggcagcttggagcagaggcagcactggccaccactgcgggggcaagtcagcgtcaagagagtccctgagtgagaaggcccagataagcccaggccccccaggcagcggacaggcacaggcagggctacagaggtgccaaggccccaggcagttgtgctaggagcctggacctgctcttccacatcctcccattacccacccctactgcatcaggcttataccttggtgccccctggaggcagcagggaggaggcttctcaggcagaagtcttaagttgcatcccattccccagaatccccaggagggagaagagggatgggctgcccctccttcctgccagagccacagctcaagggcagtgggatggccctgcacccagcccaggtaccccttcctctgtgccgaccatgctgtcctttggctccgaggaggccctgagcactgcccacccccacaccttggagggagcagacggagggggtgagtactgcacagagcctgcctggaggtgcagactcatgcactcggccctgaagaggtgagagaggctggatcttaactgtggtccaatgggcatattatgagtggtccttgtccctgcctgctatggggtaaccctgacccagctagcgtccctgacaacatgatacaaaaacacagaactctagcggatacagagatgtgtgcacagctggcaggagcactggccacctcccaacctgttccccatagcttactcctggatgtgagcctggagggactgctgggctggggagggactggccatggagcagggagctggatgccagcggacctcagacctggactgcagcatctctttggttatcggttgtgtgtgtgctcagaagggaggaggccttccccttgttacatctctctctccatatattctcccggactcatcagtttggggggcgaaaagtccaccacatggtcttggcgacaaaccactggggatgtcaccccagctgcagagctggaagcttgtgccggagggaaactgggtgagcaagggaggggcgaggctgcctgtgctctcctcaccactgctgggaccagaaaagatgggcacctgatagctcagctgggcagtcccaacgcattcccactcagccaagggcctgagcccaggccattctggttgtgtcttttcagagcagtgagacctaaaacagatgggaagaagtcatgaacttgggagtcaggccgcttcacctgtcttctcaccccacaggctcccctgagctggcccagccagcagctcacccagcctcaggcctcctggggggcagcagccacactgcccgtctgcgccaagcactgtccagggatagtcccgctgatgttgtggatggcaccataggtctgctgctgctgctgctgcggagacagtgctgtcctctccgaggccaagccgttcagaatccgaggcacgtagggctgtcagcaaatggatttgtgcttggcctggacagcgatgagcttccacactgcatccctcccctcctgcccttctcccaacaggacacagacagtggccataaaggacatatgaagaaacaccgacatccatttaggacattaagaccgaaaatatgacacctgcagaatttcctagcagccagggcaaaagagaaagcacagttatacagttctcatgatcacagaaggaagcacaagagagcagttctcagaggaaactaaacttcctagccctggatcctaggaggatttctcactttgtagaagaaacaagtctacctatataggggggcttagaacgctgccctgggacccctgggatgctcaacatatctgtgtgagtctcattttgagtctcatttcctcccaatcccaggctccagcactgaccccaggcacagagccctgccatactcctcctgagaccctggctgtgagggcttgacatcatccacctgtcctgcatgttccctgcttggccagcatagccacaggtgtgtcgctgggtaatgagtccttctgaggccctcccttgtttggaacttgtccaaggacagacaccgataagagagcctgacacctgggaggcagccaccagaaagaaccctgcagatgaggtcggctctgtcctggccacggctgtcaggaaggctggtgactacagctctggaaccctggggctctgctttcccttcccagccccaccctaggagcaggaccctggaggctgtgtgcagagagaactaggaaggcaaggagccctgtgtctctctaccatggggtcttcctctgaagcaggtgcaatgttcatttctt

SEQ ID NO: 2185 - DNA, 3457 bp, Homo sapiens
  Genbank Accession No. L26336
cctccacctcccgggttcaagcgattctcctgcctcagcctcccgagtagctgagactacaggcacgcgccaccacgcccagctaatttttgtatctttagtagagacgggctttcaccatgttggccaggatggtctcgatgtcttaacgtcgtgatccggccgcctcggcctcccaagtgctgggattacaggcgttagccactgcgcccggccccagccaggcagttttaatcgagcgctcacaaccactgagacgcagcgaagcacccaccataatatcccaggaggccgaccgccggttcagactttttcttttctttaatccccgtccaagggatccgccctcaccccccaccccagccaccccaattccctattccctccccttggacggcgccggggaaaacaagctgctcgagctttatttcttcggtgcaaccaactcagaatgaattcctccgcccctgcgtgctcagtgagtcggcaccctagcagtgaactgcatttaaaacctcaggaattgagcgaactctcccagtggctctcctcaccgggatccccttccacgcctcctccccgtgccgcgcctcagtccgcactgctcattggccgcgtgcctgccaatccgatgcacgtcggctagggcaaagaccgcgaaaaagcgcgtacacctggctctgggagcgcgcgcctaacgccagccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgatacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctcttttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaa

SEQ ID NO: 2186 - DNA, 1719 bp, Homo sapiens
  Genbank Accession No. L27050
caaacacatacaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtctaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgcgcaacatggcgaaaccccgtctctacaataaatagcaaaaaattatcctggcggagttatgcacgcttgtagtcccaactacctgggaggctgaggcgggagaatcacctgagcctgggaggctgaggcgggagaatcacctgagcctgggaggtcgaggctgcagcgagccgagatcgcgccgctgcattccagcctgggtgacagagcgagaccatgtctcaaaaaataaaaataaaaaaaaattgttttcatt

SEQ ID NO: 2187 - DNA, 6577 bp, Homo sapiens
  Genbank Accession No. L27841
tgccgcttccgcggtcacatgactccagtctagctcgcattgcgctcccgccggcgagttctccccgcgcgccgttgcgaggagacggcgcatgtccgccgcgcttgcccctctgcagtaccccgccctcttctccaccacaatgagatctaagtgcgtgctgcgcgtgcgtacgtgaggtcgaaaagcgcactgggacggcagccaggaaacgtgtgggcctctctgctgcggtctccgagggccgaccgctgccggcgcgggtcgtgcgggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagaggagctctacagggacggcaggctgcacttctagctctgcaacataaagcagacgaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttgtctaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcacgagaaaattcaagcattgcaaacggcatgccctgacttacagctgtcagctgctagtgtgggtaactgtcctaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatccagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccaacgaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagccagaattctttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctcttcaagcaaaagtattcagcagaaagaatcatgagcaactggaaaaaataataaaatgtaataggtctacagaaatatcttcagaaactgggagtgatttttccatgtttgaagctttgcaggatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtccattggaacgagaagccactagtaaaaatgaccaaaaataactgtcctgtgaaacccagttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatgtgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatct

SEQ ID NO: 2188 - DNA, 4917 bp, Homo sapiens
  Genbank Accession No. L28821
ggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaaggggtcagggctgtgttttttggcagagcatccgaagggtggatgaggagcacgagcagcaggtggacatgcaggtccttgtctatggcacccgtacgtccaaagacaagagtggagcctacctcttcctgcccgatggcgaggcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 2189 - DNA, 2519 bp, Homo sapiens
  Genbank Accession No. L29008
agtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtctgctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgctcatccccacagtctcgggatctcagggcacaatggctggacaggggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctg

SEQ ID NO: 2190 - DNA, 1973 bp, Homo sapiens
  Genbank Accession No. L29218
tcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttga

SEQ ID NO: 2191 - DNA, 624 bp, Homo sapiens
  Genbank Accession No. L29433
cgtctgtcccaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactc

SEQ ID NO: 2192 - DNA, 2282 bp, Homo sapiens
  Genbank Accession No. L32140
ccccgagtctctgcgccttcacatagttgtcacaggactaaagcaaattgatccagggggaaacactgtagaccgtgtatataaaaacactctataaactgcaatgctcaattcttagtataactattgttgttgtattgatatttattagtattggtgctcacaaaaagagtctaaattccataagtctttatattcaggctactctttatttttgaaaactcattttctatcacctttttctattttactccatattgaggcctcataaatccaattttttatttctttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagtt

SEQ ID NO: 2193 - DNA, 1599 bp, Homo sapiens
  Genbank Accession No. L32179
cactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctccatgggagttccatttttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttattaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttcgattagaaattggtctttcttagaatggtctagttaagttccacatgtagcataattcttaaataggcacttttctgttttttttttcttactgtgggatttcatttcaattttctacattgtctatctgctttttcggagattttccttcttacactgttaatcttattttaaaaaatattacattcttgtatactttatttttgtgagttggctactatttacgatgcaagagaataaatgtgagcaaagattg

SEQ ID NO: 2194 - DNA, 1705 bp, Homo sapiens
  Genbank Accession No. L32961
ggctcactgcatctccggctcctggactcaagcgattctcctgcctcaggctcccaaggtggcagcacgcaaagggtgtccctgtccctcaaggggtcatggcctccatgttgctcgcccagcggctggcctgcagcttccagcacacgtaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgttcccataggttacagcgacccggccctcgtgaaactcatccaacagccacaaaatgcgagcatgtttgtcaacagacccgccctcgaaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggattctccaaagaggagctggagacgtgcatgattaaccaggccccctggtgccccgactacagcatcctctccttcatgggttccttccatgggaggaccatgggttgcttagcgaccacgcactctaaagccattcacaagatcgatatcccttcctttgactggcccatcgcaccgttcccacggctgaaataccctctggaagagtttgtgaaagagaaccaacaggaagaggccggctgtctggaagaggttgaggatctgattgtgaaatatcgaaaaaagaagaagacggtggccgggatcatcgtggagcccatccagtccgagggtggagacaaccatgcatccgatgacttctttcggaagctgagagacatcgccaggaagcactgctgcgccttcttggtggacgaggtccagaccggaggaggctgcacgggcaagttctgggcccatgagcactggggcctggatgacccagcagacgtgatgaccttcagcaagaagatgatgactgggggcttcttcctcaaggaggagttcaggcctaatgctccctaccggatcttcaacacgtggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtgttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtggaatt

SEQ ID NO: 2195 - DNA, 7573 bp, Homo sapiens
  Genbank Accession No. L33075
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtacgtaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgttc

SEQ ID NO: 2196 - DNA, 1480 bp, Homo sapiens
  Genbank Accession No. L33799
ctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaactcctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggctctgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtcttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccaactccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggcctctcttcttatccaaataaatgtttcttaatgaaa

SEQ ID NO: 2197 - DNA, 6193 bp, Homo sapiens
  Genbank Accession No. L33842
ggccaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggtgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaagtgcgggcctatggggctcacctgggcgaagagaggggcggcacctggggaaaaggccagatgggggcttccgagagccgccttgggcgtgggcgtgggggacaggtttcgggaattggccacccacctccggggctcactttgagacatctggagcggtgcttggggtacggagaagcatctcagtagtgcttggaatctcaggccggagattccatgctccagacacatggaattgtcagggtgccaggagcactgatgacagctcggtggcagaaaaggtcccctgtacccatttccaccttgtgctgtgcctgtgacacacagactctgtcagtgccactctctgctgacatgcgttacgggttgattggtacatggggatggagtctcatgctgccctaagctgagagctttactcccaattcactcccttccctcgcagtgactttctcattctccctgggtacatcgacttcactgcagaccaggtggtgagtatgatcaggaattgggtcctgaacataaggtgagctaaggtgctactatcacctggtctctgggctaactcaccagattgggcttgggggtggattttataggatcatgttgcttgttagcatgcaggtcatacaaaagtgccttttgtgggggactcagtaacaccttgaggtgtaagggatgctttcccacactggttgacgtttgtctcctcaggacctgacttctgctctgaccaagaaaatcactcttaagaccccactggtttcctctcccatggacacagtcacagaggctgggatggccatagcaatggcggtgagccccatggggtgtgggggaaggagcaaggactccatcgcctttccccaaaggcattcagtcctgcttcttgtcacttagtagtagtctctttttatcctgtagcttacaggcggtattggcttcatccaccacaactgtacacctgaattccaggccaatgaagttcggaaagtgaaggtcagaagggcaacgatcattagcaagcgctcctgggaattgcactgaggtggggtggggtgggagtaggggtttattctaatttagtattctttcttcccaccatggggttcagttactgagaagaccctgagattctgtttcttaaagcagcagcaatagaccaggtgtacagtgcctccagcctacccatgtctctaagatgtgttggtgtgatttggtcttgtggcactgccaaagggatcgataagcagagaccccatgcttcagatcaagagcctgatgaaagtagttcaaagatgcgatgccctttctcaccatccctttccagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagaggtgggtgccactggcagagtagatccaagctctagcagcccaggttgaagacaaggggcttctgttgtctaagacatctctgatagcctcttctctctgggaaaggagtgtcaaaccaagtttctgactcctttattgggttcctgcatccttcccctccagaggctttcaaactgcccaaatgcttgctagtattcatgctttgttcttttaaacccctaaggtaggggcagtgcttgaggtctgccctgattttcttgccattgttcctgtgttgtcctccttattccatagtgtaagagggtgctccctgtgccatgttgtcctttctactcatccctcactcaataccatactgctaagaattattgggatcccttgaggaagggtgttttgggtgtgaatgtatgaacgtggtggtccatagaacttcacccctgtaatctcagtactttgggagacttgaggcaggcaaatcatgaggttaggagtttgagaccagcctggccaacatggtgaaaccccgtctctactaaaaatacaaaaaattagttgggtgtggtggcgcgtgcctctgagctcagctacttgggaaggaaagaaaagagttaactggtcatagtcgatgactggcccttcttcacatctcacctcccacgtagataatgacaaagagggaagacttggtggtagcccctgcaggcatcacactgaaggaggcaaatgaaattctgcagcgcagcaagaagggtaagtcctagagctgggaaagggcctggaactaatgcctagggtcctgattcatgtcctgccctgaccacaggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttgggtgagcctgctacacaggtgggttggggcaataggggcagctgccacatgacagtctgagacttacttcttgtcctagactcttcccagggaaattccatcttccagatcaatatgatcaagtacatcaaagacaaataccctaatctccaagtcattggaggcaatggtaaggcaagattgtgccctgaaggatgtgtggtgggagtgggtaagctgggctcccaccttaaccttcacatgagcattttcctttccttcaccatagtggtcactgctgcccaggccaagaacctcattgatgcaggtgtggatgccctgcgggtgggcatgggaagtggctccatctgcattacgcaggaaggtaagaatatactttgatagggcccacagagaccccagtttcaggccccacataccttggaaccaagcactcttatggggacaatagagccctccaataggggcaaccctggggccaaattggcctcttggatgggtgacatggctggaagcaagacaaggtcttgtcatccatcacctgccactcccttgcctagcctggccttcttgctcctgctctgcaccttctctaaactctggtctgtttgttttatttagtggctcccaagatccctccagacataaagtcccacagccccaaatgcccttctactgtcacgggttgctatagtaagtccagcccggcccactggcccggcccagctgcccactgcccggctgcttggttgacgtagctgtagctcccggggtttgtggtgctgatgggtgggcaaggccaactgatacacagaccatggtttgggggtggtgctcaagaacatagctccctcttccttctggggtgctgatagggcaggaccttcttccctaggcaggaccttttctgcccacatcttctgcagcaggcatagttcagggaccaactcctttgtgtggtccttgctctcccacacaaccactgcctgctccacacaaccacagcctgctctcctacacaaccactgcccttatcttgcctgagctgcccaccattcagggaggaagggctgggcctgacctcagtgcctctggggactaactgcacggtgactcctgccccatctgataccagctggacggggctttcccggctgctaagactgcatgtgcctgaggctgccctgggcactgcacacatgcacgtgcacatgtgggggtgagtagaggtcagcacagctgtttgtactatttaaggcagatgtggcagcagccatcccagacacgtctgttcctcagccaagctgcagtcctgatgcagatgtagccaaaagctcctgggtcctaaatatggccacagggtccactgcccgtccccattaaccctatccacccatgtgttcctccatctcaacagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccctgcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttcaggtccaaaaagttcctctagctctcaca

SEQ ID NO: 2198 - DNA, 2116 bp, Homo sapiens
  Genbank Accession No. L33930
cggttctccaagcacccagcatcctgctagacgcgccgcgcaccgacggaggggacatgggcagagcaatggtggccaggctggggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatgaatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcattggttcattaattctataaggccataaaacaggtaatataaaaagcttccatcgatctatttatatgtacatgagaaggaatccccaggtgttactgtaattcctcaacgtattgtttcgacggcactaatttaatgccgatatactctagatgaatgtttacattgttgagctattgctgttctcttgggaactgaactcactttcctcctgaggctttggatttgacattgcatttgaccttttaggtagtaattgacatgtgccagggcaatgatgaatgagaatctaccccagatccaagcatcctgagcaactcttgattatccatattgagtcaaatggtaggcatttcctatcacctgtttccattcaacaagagcactacattcttttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttagaactcctgacctcaggtgatccacccgcctcggcctcccaaagtgctgggattacaggcttgagcccccgcgcccagccatcaaaatgctttttatttctgcatatgtttgaatactttttacaatttaaaaaaatgatctgttttgaaggcaaaattgcaaatcttgaaattaagaaggcaaaatgtaaaggagtcaaactataaatcaagtatttgggaagtgaagactggaagctaatttgcataaattcacaaacttttatactctttctgtatatacattttttttctttaaaaaacaactatggatcagaatagcaacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgtttgtatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtggttgtgtatttacgctttgattcatagtaacttcttatggaattgatttgcattgaacgacaaactgtaaataaaaagaaacggtg

SEQ ID NO: 2199 - DNA, 1650 bp, Homo sapiens
  Genbank Accession No. L34081
catcacccccggagcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccgggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaac

SEQ ID NO: 2200 - DNA, 444 bp, Homo sapiens
  Genbank Accession No. L34587
agatttggcacgagtcggcacgaggcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataata

SEQ ID NO: 2201 - DNA, 1145 bp, Homo sapiens
  Genbank Accession No. L35035
gctggctatgctagtcgcttcatcgtgatcgctgatttcaggaaagattcgaagaatctcggggtacagtggcacaagggaatccccatcgaggtcatcccaatggcctatgtcccagtgagccgagctgtgagccagaagtttgggggcgtggttgaagttcgaatggctgtcaacaaggctggtcctgtggtgacagataatgggaattttatcttggactggaagtttgaccgggtacacaaatggagtgaagtgaatacagctatcaaaatgatcccaggcgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtgggggggtggggggaatgagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaatgaggtaaactgtatttaaaacctttgacttgagtctgctggtaaagcttgttacttgtctgctaccctctgatttgtttttagttagttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgttttttttatttttaatgattttctttttgttattaatatttttctctgttcctttgttattacttgcatggtttggcgtcagaagtcctacctctttatattgtttgcaggtttaaataaaacagtgtggtgccaaaaaaaaaaggaattc

SEQ ID NO: 2202 - DNA, 1284 bp, Homo sapiens
  Genbank Accession No. L35545
caggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcggtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatgcgccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatattt

SEQ ID NO: 2203 - DNA, 1610 bp, Homo sapiens
  Genbank Accession No. L35546
ggcacgaggctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtgggcggccgcctgcctgcccgcccgcccgcagccccttgcctgccggcccctgggcggcccgtgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatac

SEQ ID NO: 2204 - DNA, 3524 bp, Homo sapiens
  Genbank Accession No. L36033
tctccgtcagccgcattgcccgctcggcgtccggcccccgacccgtgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtgtggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttcccctcccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcgtgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtatgtgctgtggtgtgtccccctctgtccaggcactgagataccagcgaggaggctccagagggcactctgcttgttattagagattacctcctgagaaaaaagcttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaagtgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgta

SEQ ID NO: 2205 - DNA, 1262 bp, Homo sapiens
  Genbank Accession No. L36720
gcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttggtgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagcccccgcatgtggaagatgttcccatcaccgtggagtgaggaaaacagtcagcttgtcctggccaaaggggtttggaaggacaccaagaccccgttggtgactgaagatgacactgagctttaatggctgaagacccagatcagggcagtgaccagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattg

SEQ ID NO: 2206 - DNA, 958 bp, Homo sapiens
  Genbank Accession No. L37747
aaaagaaaaggttagaaagatgagagatgataaagggtccatttgaggttaggtaatatggtttggtatccctgtagttaaaagtttttgtcttattttagaatactgtgatctatttctttagtattaatttttccttctgttttcctcatctagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattagataa

SEQ ID NO: 2207 - DNA, 1364 bp, Homo sapiens
  Genbank Accession No. L38490
gcacgagggtgtctgcgggggtctcgcggggcggctgcggtgtttcaccggggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttataaccgccggacagacggtctagtgtttgtggtggacgctgcggaggctgagcggcttgaggaagccaaggtggagttgcaccgaatcagccgggcctcggacaaccagggcgtgccagtcctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttggggccggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctctt

SEQ ID NO: 2208 - DNA, 1422 bp, Homo sapiens
  Genbank Accession No. L38696
ttttcctccctcccttacgtccccgagtgcggcagtaccgcctccttcccagccgcgcggcttcctccaracctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggacgaaaaggccaatccagatggcaagaagaagggtgatggaggtggtgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaaaaaaaaaaaaaaaa

SEQ ID NO: 2209 - DNA, 857 bp, Homo sapiens
  Genbank Accession No. L38928
gcgtgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaatagaagtgtgaatagtagaatattaattaaaatggaggctatcagcctgtgattttcagctt

SEQ ID NO: 2210 - DNA, 620 bp, Homo sapiens
  Genbank Accession No. L40379
aaacatcctatcatctgtaggctcattcatttctctaacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgcgctcggctccggccattttgttttatacaaaaatggg

SEQ ID NO: 2211 - DNA, 1143 bp, Homo sapiens
  Genbank Accession No. L40401
cccccgggctgcaggaattcctgaattcaaaatggcctcatctcctgctgtccttcgagcgtcccggctgtaccaatggagcctgaagagttcggcgcagttcctggggtctccacagctgaggcagaacctgggccctttcctgggattgtggacatgttcgggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaaaaaaaaaaaaaaaaaaaaaaaaaaaaaaggaattcgatatcaagcttatcgataccgtcgacct

SEQ ID NO: 2212 - DNA, 1811 bp, Homo sapiens
  Genbank Accession No. L40904
ccgaccttaccccaggcggccttgacgttggtcttgtcggcaggagacagcaccatggtgggttctctctgagtctgggaattcccgagcccgagccgcagccgccgcctggggggcttgggtcggcctcgaggacaccggagaggggcgccacgccgccgtggccgcagaaatgaccatggttgacacagagatcgcattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatcgcacaggccgagaaggagaagctgttggcggagatctccagtgatatcgaccagctgaatccagagtccgctgacctccgtcaggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgaccataagaaatttactgtgaaaaagcgttttaaaaagaaaagggtttagaatatgatctattttatgcatattgtttataaagacacatttacaatttacttttaatattaaaaattaccatattatgaaattgc

SEQ ID NO: 2213 - DNA, 3969 bp, Homo sapiens
  Genbank Accession No. L41067
cggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcc

SEQ ID NO: 2214 - DNA, 1834 bp, Homo sapiens
  Genbank Accession No. L41351
agacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 2215 - DNA, 946 bp, Homo sapiens
  Genbank Accession No. L42583
cttctgactgggctcaggctgacaggtagagctcaccatggcttcttgtgtccttgtcccctccccatcacagctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctgtcctctcctggcctccagtctcccctgctgtcccaggtagagctggggatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactgtttgcaattgctaaataaagcagatttataatacatatattcttttactttgccttgctttggggccaaagttttgggcttaaacttttttatctgataagtgaatagttgtttttaaaagataatcta

SEQ ID NO: 2216 - DNA, 311 bp, Homo sapiens
  Genbank Accession No. L44424
caatgttcgccaacatgtttttctacttaaaagcaaacaaaaagcaaagcctcataatttagtaattaccatgtttcttggtttctgttctcaaatgccacagaaagatacctgatgaaaggaagcaaagcacctagtctcatcagtcttcttcaaaactttaaggttgctttcacaatctcactataaatatttggattcctatctgacagatttcttcacttatgtgagtaggaatgctctcgaaaccttagtctttactcttgcttcatactagagctgtttgattaaaccacctctgtatttgctgg

SEQ ID NO: 2217 - DNA, 347 bp, Homo sapiens
  Genbank Accession No. L44538
  unsure (1)..(347): n = a or c or g or t
ggtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaattttatctngtcctggtggtccaatttagatagcagagcaaggctgctggactgccaaatttcccccaagggaggagggncaaggacaagg

SEQ ID NO: 2218 - DNA, 2130 bp, Homo sapiens
  Genbank Accession No. L47125
gcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaaaaaaaaaaccg

SEQ ID NO: 2219 - DNA, 2679 bp, Homo sapiens
  Genbank Accession No. L47726
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggataggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcaattcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaggtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagttt

SEQ ID NO: 2220 - DNA, 1038 bp, Homo sapiens
  Genbank Accession No. L48516
  unsure (1)..(1038): n = a or c or g or t
ctgtccttagtcgaggagatgttcctggcgtttagagaaagggtgaatgcctctcaagaagtggagccagtagaacctgaaaactgccaccttatcgaggaacttgaaagtggctctgaagatattgatatactccccagtgggctgtctttcatctccagtgaattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcncaaaactctgtactgtgagctctagactctagatagt

SEQ ID NO: 2221 - DNA, 3775 bp, Homo sapiens
  Genbank Accession No. L49169
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 2222 - DNA, 3590 bp, Homo sapiens
  Genbank Accession No. L76191
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttccctaaaaaaaaaaaaaggaattc

SEQ ID NO: 2223 - DNA, 839 bp, Homo sapiens
  Genbank Accession No. L76200
atgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctgggtgacccccgacccagcctcgctgggctgtcccctgtccctatctctcactctggacccagggctgacatcctaataaaataactgttggattag

SEQ ID NO: 2224 - DNA, 2518 bp, Homo sapiens
  Genbank Accession No. L76465
ccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctgcatgagcaatttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctc

SEQ ID NO: 2225 - DNA, 35641 bp, Homo sapiens
  Genbank Accession No. L76568
gatcaaacggacttaacacaaattcattatcttccagttctgggggtcggaagtccaaaatgggtggatagagctgcagtcctcccgggagccctaggggagaatccatttccttgcctttttcagcttgtaagggctgcattccttggttcagtgcccgttccacatcactctgaactcggcctcctgtcacatctctgaatctgaccctcctacctctctctttctcttataagcacatttgtgatacattgagcccacctggataatccatataatccccccatctcaagaaccttaacatactcacatctgcaaacccccctttgccacataaaacaacctacaggctccagggattaggatatgaacatctttgggaagccgatattctgcctaccaccgcttgggagtcaggtttgaatttcagctttgtcatttcaatcttcatttcctaaatatgtgttgagtacccccatatcacgtcctgaaatagatctaagaaatacactaactagctcccgtggccttgcccaagttatataacctccctgcacctccatttttctcactggcagaactgacgagattaatatctgcctcagaggaaacgctgtatgtaaagtgtctgccggcaaccctttccacttaaacagcattcaggaattatatgctattttcatcttgacaaaatgtaagcaaaataccagattaagcagtaaagaggtagaggaacagatcctcttggaaacggctagtgtgaatgtgaattggtataggctttctagagggcaatgtggcaatgtgaatggaatgaaaagccttacaaatttttttctctttatcccagtgattattcatttctagacgtgtatctgaaggccacggctgaatttacatacaaagatgtttagtgaaatattatttatattactggaagggaaaaagcagaaacagactaaatgtcctctaataagcaattaggtaagtacacccacataatggaaatctcatcagccatataaaaggactttgtaaaagaatatgaaacatcatgttcagaggtttgccaaatgttaatgacaaagctggggatttaaatcagggatattaattatctcgtgtcggtaaaagaactccgtgtgatgagagaatgtgtatatagatagaaaaaaaaggactaaataaaatagatttcgtgatgttaacagtggttatttccaagtaatggaaacaagtgattttcatttttgtttacttgtattttctattttctaataacaaaggtggggggtttctatacaaaacaattcctctactagttcaactatcaggcatttctaggtatagaacaaacactgcgggaggtgtccctctagtggaaggagggatttttaaaaatagtttattgtattgaagtctttgggaggcaaacagaggtctgaagtcagtaaatgattctgcttattccacagccactgcactccagcctgggcaacatatcaacatcctgtctcgggaaagaaaaaaaaaattaaaagaaggatggggagtaatcgcaaaaggaagggccaaaaaccaccctaggaaacaggtgctactaactcttggcgcatttggaatattgaccagtaactttttcaactgtcgatgtcgggggattaagctccttaggcttacttccccttcccttgctttttggcagcttgaggctagggtgccaggggatgtggaaactcaaaagagacgtgaatggagcctgatatctgcaagctacaccgacagggggcgccagcccctacaggtgactccatgaatcttcggctccactcggctcttcttcggctgagttcggccaacgcttgccttctcaggctcggctctcttcggctttctgagagcgcgcctgtcgtggcctcggctcctcttcggctgcgttcggcccacgatcatctcagtctcagctctcctcggctacgttcggctggctgccgtcctctcggactcggctctcttcggttgagttcggcctactctccactaggagtcggcttccttcggctgcgttcggctgcgacccggaagagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggtgcggccgcgctggcgcgggagtgaggggactccgagagtgttgagggcctcctgagcggatgcgaggcctctgacagggatggaggggctctgagggggattcaggcccctgacactacgcgatgacacagagaaggatggcaggggtccccagggggatgcaggtccctcacactgcgggaacacagacgtatgtaaggggtcgctaggaggataccggtcgctcacaccgtgcggggacactgataagaattggaggggccccgagaaggctgcaggtccctggcaggagttgaagaacactaagaggaatgccagtccctgacactgtgcggggactctgagagggaagggaggggtcccaagaaggatgcaagtctttgaccagagttcaagaacactaagagaaatgggaggggtccccaggggatgcgggtccctgacactgtgcaggcacagtgagaatgatggaaggggtcccgagaaggatgcaattccctgacaacactaagagggatgggaggggtccccagaaggatgcaggtccctgacatgggtgcaagggcactgaaaggtgaaggggctctgagtggtaggagaggatcggaggtcgctgcaggggagggggagatgtcggaaggaggatctggataggaataacgggagagtcctgaagttggccattaagggagtttctgggggcagaaggaaggtccctgaaagggaacagtgatgaggatggaagatctctgagggtgatggggagacatgaaaggagatgctgaggcgctggaaaaaccccaatagggaaaaggagggaccaggaaataggacattcaccaaggctgtgttaagagggccatagggtcagaaagggattggagcttgacgctgaggatgttggcaaaggttaactacagttaaggacaatggagaacactgagaaagatggaatggggctacacatgggtctgaggggtgttgagaggggacacagcttggtcggacaagtctgatgatcccctagatatatcaggtggccgggagaaaaatgtcagctgagaagagtgaccacagtctctttgagggcagggatcctgtttgattcatctaggtatccccagtgcttggcatagggcctaaggcaacacacagggcctagtaaagatggttttaaactggggatataaataaaccaagccaagggacccagtgacatgaagtccctctaggatagattagcacagaactgatagtctaaaacattgtctggggaaaggattcccttgttatcatctcatagaatgtgcttggctacaaacctggctttggtgggaagtattttctaggtagcagaaatcttttaatccaggcttttaaaagtttgaggttttgtatgtgtgtgcatatgttattgtagttgagtgctgataatgactgaagtgcaattattccttagtgtaaaccccaaaacaagaaaacctcattaaatgtagactggttggctgaagttactataaagaagtaacttagtgtgtatattcattattaagttcattatctcagagaaagacagcacattattttaaatatctgtgacctattaaaaactgccctgtattaaatagcctactaatcaagtttgatttgatttaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggtaagaatttgaaatcttattattagtatgtaaatttgtacttttttttttttaagtacaatttccattttatttttctccagagaatagtctgtcttcagtcttgaaggactcagctccctacatcacctttggtaggggtcgtggggcagcacccacaggtctaaatctgggtgggggtgttcggtccttgcaggcttcacaagatcgattcctgactactttgttgtgaattgcacaactcacacagtaatttagcttcacatacatcttgggaagcacataggcgtcgaagatgctcgcttcagaaatgtccctgactgctgtggcctccactgtgttttgaatgacgaatttcttaatggctttatccttgggcacacatcaggcacagttcgtgcagcaaataggctgcacatggccgcagccctttttggcatgaccgttgtcctttcttttctttgtcatcttggaggcacggaccggagagggtattttctacatttttatttttgtctgtctcctctgctgaacgctctactagaaccttctagtgggcactactggatccttttgttcaacattatgcttccaactttcagcatgatacctgacacattgtagatgctcagtaaatatctgtgacctgaataagtaactaaatgttagattaacttttcattgttttctaagctcttattcagtaaatacttgcaattcgttagcatttgcttttagaacttaatcagatttgaaatgtttataaataatctttgtatatttcctaaaatatttagttttcctccttaagatttttttggcattatttgaaattaaatcaagtagttgcttgcttattttgaggaaaaattattttagctagaattaaatagaaaagaaattcattttcattatcctttcaaaaccttttctgatgtccccaaagctaatgtaggggctgtgcctctgtgccctcatattaccctgtatttctccccagtcatagtgctcacaacactacattatatttatgtgtttgtctatctcactcacaagataagctgaagcacaaggaacaagttgttcatcccaggctaaataactggtacatggtaggcactaaagacgtatttgttgggtgaatgatggatggatatagtactgtgatcgttagtgaacttctggaggcagagagactctgaaattcataatcttattcccactgtatctgtcatgttgccctgaacctagatgaccctcaagaaaaatttgataaataaatgtgtcaatgaatgcttcaatggtaaaccgactgaagaagtttggttactcttttataacttttataattgttataaacagtatcataggctcacctggttttgaatgctaacaccctgcttacaaagcaaactccttaattttcattaaccccagttttctcattaagaaaacagtgcttcctgaagttattataaggattaagttaataaaataatttcttagtatagtgcctggtacacaacaaactcttagtaattcataccaaataaaattggccttttgtaaccagaaatcttgatacaccagtcttttactgtttgctgctttcttataagcttggttttactttattttttaaattgatttaaaaaaatttttttgttgtgtttaaaactaccactaggtgtcagtaatatcctgtgactttcagttacagtgcaacctaattaggcagagagcaatgtgaatttatgcaacgttgaagtctggcttatctgtagctcctaatgaaaaatgccaaattccctcctcctttctgatcaaagcccaccgaataatgaagctggagctgttactgatgcttggctgagtggaatgtaaatgaatgccaaaaatgaattcttttgaattctttcatcccctgggatcatcccccaggactgaccaaagagcagtgcgtgaagtgcaggtaaccctctggaaaggctgaatcccccagccccaacttcttcacctgtcaccacccattattaccaccacaccccaccctgggaatccctgctaaccagaactcctaacacgtgggagaactatataaatatctggtgaggttgtaccttgaaaagaacaggacaggaggatgctttcattgccaaaactgaccctgacatctccagacagaactaagaacacactttctgggaaatatatatgtatttttcagttacacttttgatttgtgtacccagtgctgtgcctccactttatattcattcaacaaatatttaactcactaagggtcccttgtttggcaggaagggtgctgaagatagacagatgaatgggacagtatggtgaactcgtgagttagactgcttctgggtttgagttatcttcatcttgcaccagctgtgtatttttaggcaagtttcttaatttctctatgcctcagcttactcacccgtacattggtgataaagatagtaccttcctcctaggattgtcagggtgaaatgaaatgcttatatgtaaaatacttggtagcatggcacatagtcagcattctatgatctctgtgatctctgcctgttggtgttacgatgttcctgttctcgggcagtttaatggaggagacaagtaaagaagtagttatagtacagtatgggtacaaaatgtcataggaacaaaaaaaactaaagtaggcttttgtggagctaaaactcctcccaaaaacctaacctgcttctattatttttattttttgaaaaaggagtgtcttgagttggtgtgactaaataggaataacatgattttacacatgatttggaaccttcggcctcccacttgcttgctggatgaccttggttaagttgcttcccttccttggtctcatcatgatacctactgcatggaattatcataacaattaaatgaaatgaaaatctatagaaacacctaacccagttacctgggatgtagtatcagttctcttcttcctcctgggttccaaccaaaataaagacaactttttggagcgcaacattttcttaaattgagtttctccttttctttggaagttcatttttattattcttgactctacgtaatatttcaatccaggctaacaaaatgtggcctcttagagtccttgggaaaacccaccaattaggtacagaatattttctgagtagtaaattagttatgtacgtgtattgggggggttattgaaaatcctttgtctatgaattcctaaataacattattaatttttactatatttggaagataatttgctgagctagagtaaatttagctccatccacctctatccaaaacttaaacattaaaatagtaaaatctgagtttagtttattgaactattagaagggtcataaatcactgttagtattattgtccatacccttccagatatgagaactggatcaaaagcatgcaagtaccattatgccaaatatatataaggtaaccagcttgatttaggtctaaaagacagactcgtcttggagtaattgtggttttgatctagaaagcatgtctgtatgcctttatgtcatctcatgtttctccctaacttagcactaatcacactgcatcagatgacacaatatatatgaaagatctgggtcagtagtctcatttcataaataacaaagcatgtataattgttcttatttttgagatgctgaggtgttataatcatgtacacccccaaagacatgtataagtatgtcgattgaaggtttttgttttaaatggactaatttacctctgaattgactatcttctgattctgaaaattgaattcatctcataggtaatgtagatgttgcccagacttctaaaatgtggctattttgtatagtccacatctgattcatacattaaaaaaaaaaaattcatgacctactttgctttcagaaattcttcctctgacatgccagaaacaccccaccccagggcctgtgccctcactgtcccctcagcctggcagcctggaactctcttggcccagatggtcacaaggctccatccagcctttattcagataccaccttggtgagaccacccctcatacatactccctctcctccttctctgattcattttttcttctcagcacttgtagcatcctaaatattttacgtatttatattgtttatagtcaattccttgaggacagggatttatctctgttctgtgcgtggctatatgcccagtctagaatggtgcttattcattctcttgtaagtacttaagaaaaatgtgatgaatgaatggcaattacctacctgttctgtagtttaaattatgtttctccccctcaggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggtaaagaacattatgtgacaaataatgatgacattatttgtcatctttgtttgtgagatctactgtaacttagttgcactttgatgtaatataatgtaaaattcattgtaattttgtttgatagaacctagtcagttttataacaaacacatccagctataaatatgtattcaccaagtttgtggttttatttaagtcgagagcaatttgatggttgcttttctgctggtccatcacatccatccaagacagccactttattctttcttacacatttagggaaactcccagggatctagagacccacatatacaacagctttaggtgtacagcagatttattggctaacattaccacttctgctttgaaaattactcaacagggaaataaagcacaaaggttttgaagaagttttattaatttctaggaataacattaaggtttcagttttcaaacatttttgcaacctatgctaccatgtattttggttataatatatgttattttgagagtagttgtacaccgggtgcagtggcttacgcctgtaatcccagcgctttgggaggccaaggcaggcggatcacctgaggtcaggagttcgagaccagcctggtcaacatggtgaaaccctgtctctactataaatacaaaaattagccaggcgtgttggcacatgcctgtagtcccagctacttgggaggctgaggcaggagaatcacttgaacccaggaggcagaggttgcagtgagctgagatcgcaccattgcactccagcctgggcaacgagcgaaactccatctcaaaaaaaaaaaaaaaaaaaaagagtagttatagtatttttaactttcttgattataccttgttttaggagtcaacaaactcttcatgtaaatggccaggtagtaaatattttgggctttgcaggccatatagactgtcacaattactcaactctgttattgcccaaaaacaagtatagactgcttacataagtaatggtgtgactgcattccagtgagactatagaaacaggtacaggatttggcccagaccgtagtttgctgaccctttccttatctgaataatacactgcttctattcattgaggttcaaagtgtttttgaaaatgttgttgctttgcttttcatttgtttgttgttttgcttttcgtgttgtttgtagcatttataaaaatggggtgttaaaccaagaccagaaatacatagctgctgaaactctagaaaattgttgaaaaatatttgtctctttaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaaggtactctttttccttttaagcacagtttattatgttgtaattttaaagaatgcaagttattttaatatttgcaatgttgttaataggaatttgctgttatttaagaataaaattggaggtcacttaaaaacatagcttctttggtttactggaaagtaataatttatagtaaagtatgtggattggcatataagcatcactctgacttttgcagttatagtaagtgattatctcttattttaactataatcaagaagaaaataaataactttttttactttgaaatgacaacacttggatgtctacaggtagaagagttttacataagaatgctccataattgtacatgaatttatgatctcttttatggaataaaaaataatttggatgagttttcattactgaggagtgtgaaacttgctctgtcttaaaattacattctgaattgaggaaatggtaagacatcagttccaggaatttttattctaactaattttttattatagattaatattgcagatatataaatgtctactttttcattatagattaatattattacagatacataaacgtctagtattgaattggagatccagaaaatgctgaccttttagaaattcttggcagcctttttgtcatattctggtagaaaaagtttctgtcttttaaactctgagtcaatctctatgtcactggcaataatgcgtggcgattataaaaaaggaaaaaattgacttatttctctgattcttcaaaaaagtcagttgactatgaatattgatacataaaactaattttatatattctgttcctctgtgcttaaagttttttatgatttagtccatggtgattttttttaaatcccacacaatcttttaatagaatgtgtatatccctagaaaaataaaattgtagcctaacatgtttcacactgaatttctgttgattatcccccggttagtaacagtcacttcattgttttagatattcttttagtaaccatatctaaatatagatatcccatgtgtcttgttaaaatgtttaatattttgtagatgattttacaaaaaaggcatgtagttatatatcccagtttgttcaggatagtcccagtatctacctgttgtcctgcagtgattataaatagtgtatcatttctttttccacaagtgttctggtttagacaataaactatacagtcatccagatacttctcctgctcattattaaatttgttagataagattccgtgcaatggtactgcttttatatcaggctacaaatttctgattaaaaatcagataattctgtacctaaaaagtaacagaatcagtctgtgaaggaaacatacatatacatagctgtggatatgtaggtacctacatagtgtatacataaagctgttctttgttttagacagcattttggaatcttaaaaaataattggccgggtgcggtggctcacgcctgtaatcccagcactttgggaggccgaggcgggcagatcatgaggtcaggagatcgagaccatcctggctaacacggtgaaacctcgtctctactaaaaatacaaaaaatgagctgggcgtggtggcaacgcctgtagtcccagctacttgggaggctgaggcaggataatggcacgaacctgggaggcggaggttgcagtgagccgagattgtgccactgcactcgagcctggctacagagtgagactccatctcaaaataataataataataatcaaacttagtccattgttaatttaacaaatattttcctatcatgaatccactttagaaaaaaacactaaagaaatttttacaccaacaaattatggtacgttgttatttaatttgataattcttatttaatttgtacatgggcatcaaactaaatttttcatttcttggttataccttattttaaaggtcaaaaaacatgatactcatgtacaaattaaatagcaatgtaccttaatttgttagtaagccatcgtgcttgtgtatgccctctgcttggtccatttggatcccatgtctttatccatccaggatagtcagagtcaaacttggcaggaattgaacatatctgagctacatgcttagattctgttcataaaaacaaataattgattatctgatgtttataaggtcttttctcccctgacagtaatatatatttggatgatagattgactctatctgatcataaagattctagcagtaagacattcttctatatttgaaaatttaaacattattattagaattttattaactgaaatgttctagccacttccttgaataatgcttgcagtttttttattgtagtaaaatatatatgacataaaatttaccattttaaccatttttagatacacaggaaataatccttttgaaagtatgatttgtattaagaataactatacttaacatattttagcaataccaaattttattcttgttttagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggtgggagattaaaatactaataatattctaagagctgatttgaataaagtgttaggttttagggggaatcaggtgtgaaaagtgctatattcaactatatgttatactgagatttcaaattatgttttatgttcatagcacaaagatgtaggttttattgatagctaatgtttccgcctacttaacgtctgttctgtataataataaatattcatatccgttccgggcaattttatttctagaaaagactgtgtgtagtacaggcagtcctcaacttagaaataggttgtgttctggaagtttagttgttaagaacttaaaattcattttcctcaaagcaaaagcaagggagtatggggcttccatcagctagagtgccaaagactgaagagcagaagagattttagggaaatatacatatacagctggccaccatctcgtttggctaccactgttttggcctctgtcactgtttgaccagaccagcggttttcaaagtgtggtccgtgaacccctggggtcaagatttaatacagttaataattctgatggttctttagggacattcttaagtgatgaactgcagaagcatgacagtaaagaatgcactgaatgccagtacactttcatggcactgccttggttcatgctacggcaccagcatgtacaattatggagcattcttatgtaaaactcttctacctgtagatatccaaatgttgtcatttcaaagtaaaaaatgttatttattttcctcttgattatagttaaaataagagataaccacttactatataactgcaaaagtcagagtgatgcttatatgccaatccacatattttcctataaattattactttccagtaaaccaaagaagctgtgttttaaatgacctccaattttattcttaaataacagcaaattcctattaacaacattgcaaatattaaaataacttgcttttacgccatcactggaaatgtcaacgcagtgaaaaaagtcaaataatgtcatggtattgttacgagaaaagttctgacatcacatagccctgaaaatatcttgggggcccctgggagttcacggaccacacccagaaaaccactggtccagctgaacagcgacagatcacagtagtgggaggcggtgtggttggtaggaagacaggatgacagccagttacgtatgtaggtcatgtgaccatcagagactgttttaaattaaccataaattgatggcactttttcttttaacttttcatattaggttggctgtttcttgactccagcacctcgatgtttataaatgctcgagcaagggtttatcatcttccagatgccaaaatgagtaaaaaagaaaaaatatctgaaaaaatggaaattaaagaaggggaaggtatcttgtggggttaagtctttaaatgtgttttttatttcggtatttggtatggaaatttaaagtgcaatttaaagtcttctttggccatgtgaaaagtgtgttccttgaagataaatgtatgtatgtttgttatatgtaacatgtaatgtatgttgaaagtatatatgtaaagtatatgtgtaatgtatgtcgaagtatacagcatggcaagtcttgcagtctattgcccagggcttccaaataacagatgtcaaatattgatcaaaagtatgctacatgaggagctatatattgatttttttagaacttcaaagtaattattatttttgagtcagaatgaggttggggcatggtggcacacacctataatcccagccctttgggaggccgaggcaggaggattgcttgagcccgggagttcaagaccatcctgggcaacaaagcaagactccatctctacaaaaaaaattttaaggctgggctcagtggctcacgtctgtaatcccagcactttgggaggctgaggcaggccgatcacctgaggtcaggagtttgagaccagcctggccaatatggtgaaaccccgtctctattaaaaataccaaaaattagccaggcgtggtggcgggcacctgtaatcccagctactcaggaggctgaggcaggagaatcacttgaacccaggaggcggaggttgcagtgagctgagatcacactactgcactccagcctgggcaacagagtgagactcggtctcaaaaaaaaaaaaaaaaaaaaacacaaaaacttttaaagtagcctggcgaggtgatgtgcacttatcgtctcagctacttgagaggctaaggtgagcccaggagttgaaggtgacaccaagatatgatcacaccactatactccagcctgggtgacagagtacgactgtgtctcaaaactaataaataaagtcaggatggaatatttgaatatcctttttaatttttaagcaacataaatatactagaatgaggcaaatatgggttttattccagcatcttatctagtgataccgtaaatatcactagttttttaaggcatgggatagggttaatgcctgctttctgcctagtttaaaggtctgtttcaaaacttaactgaggccgggcgcggtggctcatgcctgtaatcccagtactttgggaagccagtgcaggtggatcacctgaggtcaggagttcgagactagcctgaccaacatggtgaaatcctctctctactaaaaatacaaaattagccaggagtggtggcacatgcctgtaatcccagctacttgggaggctgaggcaggagacttgcttgaacccaggaggcagaggttgcaacgagccgagatcatgccattgcctccagcctgggcagtaagagtgaaacttcgtcttaaaaaaaaaaaatctttttaaagaaaacttaattgaatatattattgatgtgtttgtgtttgaatgcgtataggaacaaaaaatttaattgttgtctacttttatccatgttcaggattatgaaagtcatggggattttagaaatagtaaatactgtcattgtgtaccgatgcctttgttttgtatagctgcttatatatagtgtcacagaaacaactaacacagaatggtctctcattagtgaccatgcatataactttctaccaaggcattttgaaagccatattaatggtttgaagtatctttcatttacaccttaagtagatctttttcaggaaagcagattccatctaacattataaagaaagcttaaataaatgggcatatgtactgatgctcgtgttatctgttgttttaaaagcctttggaagactttatgggtaaatattatcacatagaatgagatatttttatttctctacagaaacaaaaaaggaactggtcctagaaagcaacccaaagtgggaggcactgactgaagtattaaaagaaattgaggcagaaaataaggagagtgaagctcttggtggtccaggtaggaaaaaaggagatgaaaacatttgcttccaaaatctatcaaatgagtcctgatttaattagctctttaaaagtagttcaagactagcctgaccaacatggtgaaaccctgtctctattttaaaacactgctattttatctataaaatgtagacaaataaatggcaaatgaacactgagatcctagtggcaacctcatttctgttcgtttgatgttgttttctccaggttgaatcattgtatattcatgaaagcaggtttttaaactagttgggttcttagaacttctatttaaagattgagctaatctctacacatattcaccaagctttaaatctggaatccccaaggaataaactaatgggtctcctgttttatatcctcagccaagtatctttccaaaaaagcctcaactcttctattacttcaatatgtaatgagccggtacaaactgaagacattgtctaaattggcagaggagactaacacaattcacaaaagaggaaaaatccatttggaattaatttaggcatatatgagatcctctggaaaaaaatattaattaaaaagaacttctttaaagccccaattacaccacagttgtactttcataagattaaatagtctggcttcaactttactgaaaagatttaagtaatcttgccagagaggagaaagcatttgatcaatacctaagaccctttttaaatagtttgtaaattgtggatctttaataccaaagggtaagatgtcttcccttcgggtgaaggaataagggggcacagggaaactaggaggacaagtgaggtaatagtaacataatgttgttttctattttcaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgaggcaagttataaagaatcacagctttcagttgcacagttctttaggatttaacccagaaactataccagttgcatgttagttttctttaatatccgttacgatgctgcttatgtttatgaaaccttattttgcttcctgatgaatctgggaagttggataggaaggatgtcaagtatcacagcagaacaacaaaccaaggggactgctcttgttctcgttacgtgctgctgtgcgttctctcctttattctttgggtattggtttgcatcgtatggggtactgtatctgaaaaagtctgggaaatgcataatattctaatttctaacaaaagttaatataactgtgactcggctaagtaattttaatcttctaaaatatctttcctataaattttaagaaatgactctaaattacatccatataaaactaaagtgttgggggaattactgtaccaggttttcttgagtttcaagatatatcagatgaaacatctacagaaatatcagatgagaaaatgatgcctcccaaagaagatagtgttctggctttccaattatctgaggggaaataaacagcaaaattaatatcctgaactcagtctgaaccaaaaacggagccaaaagaaaccttcccctagcattttaactaacacagcctttcagagtagagatgaatggaggagctggatcagaaataatgcaggatgaagagattagatgaggctggtaaaataattataggctggtaaattttttgtaccgtgctgttgatcaactttgtagatagcttatgtacaccaagcttctttcttgcctgagaacagaatagtgtggtatttgggagcaaaatgttagaatcagaagggacctgggagttcaaccacttactctatcaacgggaaactgaggcccagaaatggtgactgagttggccttggccacatgacacatccgtgggagagctgagtctcttgactcatcacccaatgatcttttctctgtttacacttcaaagaattatcatctaggaagataacagctaaaagaaaaaccaaggctcaaaaaggaaaatagctttgactgaaggtgaagcaaagggacagaggaggtgcttaattcagctctcttagcaacaaacaagatggaaaagcaggccttttttttttttcctttttttttttttctttgaggcagtgtcttgcccagatgcccagactggagtgcagtgttgcaatcatggctcactgcagcctcaacacctccccctttccctgactcacgtgattctcccacatcagccccaagtggctgggactacaggcatgtgccaccatgctcaactaattttttttttttttttgtagagatggggtctcagtatattacccaggctgatcttctgagctcaaatgatcctcccacctcagccccccaaagtgctgggattacaggtgtgagccaccgtgcccagcctaaaaaccaggacttttctaagagaaagtagatcaaattattctttgagatgcctgatgtaatccatacgtcttccatgcccatgtatttatataaaatgtgtgaccgctgtattctgttaagacatgaattaaaaaaaacgttcataggctggttttcataactactgtccaactttttaaatgattgtttggctgaggtacaaagaaagaattggagaagcctctaaaatttgtgtgtttttctgtttgtttatagttatgaggagagaattattctatccctctagttatatttcagtgtttacctaaactcgtttcttccttttggcaaaagaaaataaaaaatgccctgtgtggtaacgagacctttaacaggtggggtttaggcagcttaatttgagctagtgtgtgataaatgaaacctttgattcttagtcaaatatttattatttgagcgctctaggttgctgatttcacatgttctgctgttcctttcagggattaaaaatgctgtttttccaacctaaaagttctgtcttaacatgcagggtttactttcttatatacggaggttcaactgaggaacaacgctatctcactgctttgcggaaagaaaaggaagcttttgaaaaactcataaggtaatacatagaaaatcagtatgaaagccccaactacattggaaacctctggatgggggaatatcagatagtcctgctcaggaaggatagggcaaggaagacgttggagaggatcacattgagataaacctgtggtctgaattgtcctccagtgtagatctcagcacatacttcctttttctcttccccgtctcttccttcatctccagttgcttttcagtggtttgtttaatagaatattagaaatgtgacaaagacaactgcttttttgtttgtgaagcagtatgataaaacacgagaaatatagctaaaatactgcttttctaagaaatacattagtaaatctccctcctccctgccttatgcacaatatgtccttgggtgggtggctgctttaccgtttattgggaaatgcttttacaacacagccaattatgatcaccatcaatagaatcactctgggaaaatatttcttaggaagtgtgttgtttgtctggacatacacgtgtatgtttttaagaatgagtatctggtactattccaaatccaagtagaaaatgcccttccattttacgaaaggaaaatggtgagatgttcacaaactggttggctacctcttgccctgaaggcattcgataaatctgataaccacctaccagggatattgtcaagaagattgcagcctggtgtgggaagatgggccagataatctctaagggcctcagaagccagggcaagtgctggatggggcatcacagagctgagccagagaaagttagatcagcagagaccatggcctggacggagtgggctgggccagagcaaacttccaagcctcagacattggcaatggagggcagaaattatttttagcagtagtcaacctgcgaggactgccaagaccctaggccaaatttcaaaatggataaccattctgcagtggtggctgcgggttctcagtgtatgtgcaaaatatacatataacctggatagcccaggagaagaattcttggaaatgggggtatttgctgaatcagtggcatggagtcccacgatgggggtcagcatggtgcatgggcggtcccctcttttcccttcacatcctctcgaatggtgatatgccttggccatggattcatccagctgctagtcatacaagtattgctcagtcctctcagcctatgaaaatatgtttcctaccagtgtgctctatgggattgtttatgtcgtatatgtgggtatatatatttttcaaaaacctagttcagaaatcgtgttataacagaccaggcattataccagccgcctcttgttccaggctctttgctcctctctgtcttactctttgtctgctagaccttcacgccacaaggctcaaagagtaaacaggtatttattaagcatctggtatgtgccaggccctgtgctaatattaaagtgctgaggttacaagtggtgcagaaaaagcctctgccctcctggaacttaccctttagtggaaaagacagacattaaattattataaatattgtaataagtagaggtatacagagcaccgctggctgcaaaggtaaaagaagagggtgtaataggagagtacatcaaagacctcacccagaccacaagctgatcgggagccgcttccctgaggaaatgatattcaagctgatactaggcagatggggtggaaagggggttatgttgaacaaaggcgtgcacgaaggctcccaggtacaagaggccctgtaaaggatttagggcttcacgggcagtaagaccgcactgaagcattctaagtaggaaagggacttaggtatgtttgtaaaggctttctctggcatcaagctgaggagtgagtgagggtggaaaccagtcagaatgctagtgcagtctgatgggagaaggtggtagccaagattaggttaatggaggaaagaagacagatttgagagagatttgggagatagaatcaaagaattggtgatactggatgtgggccagtacctcctgaccattccttcactctttttagaacagcctttgcccaagttttcgctcattaaaataattgtcacctagatagaaatgagtgcacagagctaaaatactcagattgggttttcagtgttcatgtcagggttccccaagatcatcctcaggctcgatgattcactagaactcacatgagtcagaaaaggtgttatactcacaatacagtttcttccagcaaaaggatacagattaagactggatgcagtggctcacgcctgtaatcccagcacttttgggaggccaaggcgggcagatcacttgaagtcaggagttcacgaccagcctggccaacatggtgaaaccctgcctctactaaaaatgcaaaaattagccaggagtggtggcgcatgcctgtaatcccagctacccgggaggctaaggtgggagaatcactcaaaccccaggaggtggaggttgcagtgagcttagatcgtgccactgcactccagcctgggcaaccgagtgacccccgtctcaaaaaaaaaaaagaaaaaaaagattaaaatcagcaaagggaaaaggcacatggggcaaagtccaggtaaaaccaggcctaagcttccaggtgtcctctcccagtggagtcacatggatgtgctgagtcctcccagcaacagtgtgtgaccacacatgcaaagtgttgtcaacagggaaactcacctgagccttgagtccccacatttttactgagctgagtcacatagacacagagtacctccatggctggctacagctcctcagactccagcccccaaagcagcaacagacatttacgataaatcacatcgtcagcataaactatctgatccagctggcacattgtgacccaaggcctcaggcatataaaaaccttatcagggagaatactccaggggctcagagctcatctcccaggagctgaccaagagccagtgttgaggagagaagcctttcttggaaacatgcagagtttgagcagcccaggcctgctgagttaatcctttcctgcacagcgttagagccagaggagcctgatagaatgggaggaagacagcacctgagtaggtgagtttcttgcttcgcctgtcttcatgcagctgcctcttctccagtgcatcagggaatctaatctagaaaagagcacttttagtagatagtagtaaggtaccagatcccatgccattcctgatttatgcacctgcttctacacatcaaaggactcagtgacaagatgtggattagccttatacatactggaaaacctcactcagcagaacctggatcatggactctctcccacatttcaatccatagaaaaatttctgcaccaggttttaacataattttatctgttatctggcataatttttaatgctttcaatgatgattgtctacttgtcataaataagatcttcccattttacccagcagtcaatcagatagttgcactgttaagaatcttaagatacttactttcccaggaaacttgggaaatttgagaggtgcttcttttgcaaagcaaaaacatatttgaggtgcattgttcaaaaaacatttgcactgtgtacttaagagaaaaatttaatatgaagatgagacaatgtgcttttaccaagacctccatgggtgatgttgtaagaacaaaagcagttgtggctctttaaccagaaaggaacaaatcaggtgaactgacagtgaaaggattgtttagctggattaaagatctgtagattatagataacagataaagtggaaaagattacactgctaaatatcataataattttatttctacccagggacgtaaaatgctccctgggtagaaaacttagtaataacatcctcagtatacatagctttgaggaggtcactgcttttcaaaggaaagggtaagattatttgaaattttactttttgaaaatacgatcacaaaatgggctagcatgagggcttaagtaaatgcccattggaagagacttctagttcagtgctactttcctatgttgccataggattatgttgtacacggtattcaaataacattgaagactgggtgcagtggctcacgcctgtaatcccagcaccttggaaggccaaggcgagaggatcacttgagcccaggagctcaagaccaccatgggcaacatgtgagaatccatctcaatttgtttaaaaattaaaataaaataaattttaataaaaataccattgaagatactaaagcaaacataggaaagcttggtgctttaagcagaaataggaatctgaattttttaattgttttgtgtctgtcacataggggaacttggataattatgccacatgttgaaagcaagagactggctgtttataattacgatacatttctgttaaactgaattactgcttaggaaggcttattttcttcatagtccaggtttcatctcgaatatattttttctcacattcgacttgtagttaagttataacatttagtggtaaactagctgttttctgtagctattaatggaaacaattgtggaattatttgaaagcaaatcttcagttttttagtataatcatggataattagacgaagagattaccacgttataagaaaagtacagtaataataacacctaacatttatatagtgcttactaggtgccaggcactgttctgagcgccttgcatatgttatgtaatcctcataacagtcttttgaggtaagtttttaaattattatcctcattttaccaataaagaagttgaagtacagagccatgaaatgacttgcctaaggtcacgtggccagtaaatggtttcagatccacacactttggaaccggaatctgtactctaaccccctaagattatacagactacaaattaatcaggaaattgggatgatcccatgtgtgatatacagcttagccagtgtaacaagtagaaacaaagtgggggacacaacataataataccaaatgaatgttaaggaaaaatagaagagcagtaatttttttgaatggtctgccctttgtcctaaccagagtgcaatagagagaatggagtggtaatgagtggcagccagagccattgccattgcagagggcttttcagcaggtagcgcttgagtctggtattgagaataatgagaaaaacatggaactgaaaccattgtctgcccccttgtgatctacttataaaatttgtactaataatatatttgcatttataggttgtttcaaatagtataaaattttaaattacaatttctgttctttagtagtatcttctagtgataccctgctctaaaatatttatccagagtggttgaagaattgaaccctctgatttcatttcctctaatgggtgtattagtccattttcatattgctatgaagaaataccccagacttggtaatttataaagaaaagaggtttagttgattcacaagtttcacatggctggggaggccttgggaaacttacaatcatggcagaaggggaagcaaacttgtccttcttcacatggcagcaggagagagaatgagtgccagcaggacaaatgccagacacttctaaaaccatcagatctcgtgagaactcactcactatcatgagaataacatgggggaaaccacccccatgactcaatcacttcccaccaggtcccttccaggacacatggggattatcggaactattaattcaagatgagatttgcgtggggacccagccagaccatatcaatgggaaaatcttggttgttttaacccttgttgaaattaattaacattgatggttcctcttctgttcccctcaccttagtctgttttatcgcagttcctcagttccagttgtttttttttttcttctcatgtttgctttgttccctcgacatcagttgtgaacccaagcagggaagagactcagcttatatatcttttctgtcatacctggcagaattaattataacatactttatcaattttgaaaaataaggctaccgcaaacctggcttactctttctgtgattattgaggatcttgtcatgatgtagttccaaattgcgaatcttagttatgattgtactgtcctctagatctaccgtataagatatgagccaccttgaagacaggaattcttgcgtgatcacgattatatccaaagtacctagagcaccacgcaggaacactccataaatgtttttcaataaatgcatgagtgagtaatgaatgctgctcccaaggcataacctgagctgttgattttttgttttaatctctgatagaaatttgatttcttatatctatttcaaaatcttgatcttgattttcctttaaaactcagggtgtttaatgggacctcccacctggagtttttaacatcaaaattctatcatatatgttttttagtttcttaatgatttttaaccacccctatttgtgattaccctgaaaatgtttgaatataaatgatttacatttacactttaaccttacaaacagtctcaagaatctcttggtggcattttttacatgtggcattttttgacatgcttgtgttgtttcttaaatatttgaatataaagtcaaaataaacaactgctttttttactctggaaaatcaagaagtagtatccgaccaaggcactttttactgactttttctacttcctttacccatcatttgtcttggcatatttacttctaatatattccttgtttttgtttttgtttttctcttactgctatcatcatgtagatcattttcaatactacaatttacacacaataaaatctagaattttgaaatttgtttcagaagtgttgacaatgttttctcccacagggaaaaagcaagcatggttgtccctgaagaaagagaaggcagagatgaaacaaacttagacctagtaagaggcacagcatctgcagatgtttccactgacactcggaaagccggtgagtcctgcactttgtcaggcacctccattgcctgcaaagggggctgtgaagttccagagttactctgccaaggcttggtctgtattaacaaactcttaaaaatgggggttgggccaaggagaggatgtgtacttccctactctaatctcagctctgccattcactaaccatgtgtcctccccagagtgaaggcactgtgtcatctgcgaatcatgtgaggttgagttttaggcaccccagcttagaatgggttatgttccagcatttcctttatatttggttggttgagactcagaatgtacttttgcaaataaactttgttaaacggtgattaggttcttatctcaacctaaaaagccagtttaactcagagtagttaaaggaagtttctccttccctcctctgcctctccccttagttgtatacataggtggggtgcatacactcctcctctccttctgtattcatttcttcttggtagctccccagatacctggtgtctggtacgcattgctgtgcagtgtccaaactgtggcatgccaccaagacctgctgaattccaagtgcactgtgatccagaagtcaccattttcccattccccaaattcctattttcctatgccagcagctgatttcagccaggtggcatgagaaaagcaatacgattgagttggtttaaccttcggtgaggccaagtacagttgaagcagtgggtgtcagaatttagtagactttagaataacctcagatgctcattaaaactgtagattcataaccctcaattcatagaaattccaactcagtggatgtgaaatggagccagcagctcgggggcttctgatggaagtggtttttggaccatactttgggaaacattgcctcagagcctctgtgtcttgttcaaagaagattctttgaaatatcaaccaggttgttgacatttcatgaagaacgacagaatgtaaggcagtatgggtaccacacagagagctgttcgtagaagtctttccttagagatcagttctccacgccttcatattagttgcctatggctgctataacgaattaccccagacttagtggctcaaaacagcacacattttattatgttacagttctgcaggttcaaagtccaaatgggtttcacaaggctaaaatcaagatatcggcatggctgcattcctcctggaggctctaggggagaatccctttcctggccttttccagcctctagaggccacctgatttccttagcttatagccccttcctccatcttcatagccagtagcatagcatcctcccttctctgatcatcctgcctccatctttcacttctgagaatccttcagcctacctagataagccagataatctcccaatctcaaaatgcttaacggagatacattctgagaaatgtgtcattaggcgatttcatcattacatgaacatcacagaacgtgcttacacaaagctagacggtctagcctgctgcacagctaggctatgtggtatggcctatggctcctgggccacaaacctgcacagcatgttactgtactgaatactctaggcaactgtaacacaatggtaagtatttgtgtatgtaaacacatctaaacatagaaaggtacaaaaatacagtattgtgatcttacgggatcactgtcttatatgcactttgtcattgaccaaaacgttgttgtacagcacatgaccgtattaataggttgcagggatttggatgtggacatctttgcggggtaccattattctgcctacagcagcccttgatacttaaaaatgtgatccttaaacaagcagcattagcatcacctggcattttgttatgaatgcagattcttagaccccttagatctcagacctactaaatacaacatctgtttttttgtttgtttgtttgtttgtttgtttgtttttgagacggagtttcacccttgttgtccaggctggagtgcactggtgcagtctcggctaactgcaacctccacctcctgggctcaagcaattctcctgccacagcctcccgagtagctgggattacaggtgcacgccaccacacccggctaattttttgtattttttgtagagacggggtttcaccatgttagccaggatggtctcaaactcctttcctcaggtgatccgtccacctcggcctcccaaagtgctgggatcacaggcgtgagccaccgcgcccggcccgaatctgctttttaatgtgaccccaggtggctcatgtgcatgttataatgtgagaagctgtggtctaagatgttcatgtttttcccagctccttccctttccccatctctggactcactgatataaatacaatagtccctaaatcactagatttgctcagtgagcatttttaacatctactggggccgctattttaagcctctaccctcaggctttgtcctaggaattgggaatacattgaccaacaaaatgtggtcagtgaggaaactacagaggggagaccttagcaggtatgtgtggatttatgaatcatcgcaagtaaggaactactgacagtctaactttcctattagctcggtttccttcaagggaaattgcctctactttataaacaaatctttttgaaaatatagaaattatatggaatattaccatatagaattatgtaaccatccatcagagttaacaacagaaacatcgatttttagattttgttatattccttctttgagagttcttccccagtgacattacttactttttctctgtaggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagaagccaggattcctctctgaactctgcagttaggcatcacttgaacttgcctgtgcctgctctttttcctccctgcaccgtctatgccgggcttagcatgtttctttttaaatgaggtttgtcaggatcaggtaaagttcctacaagtgattacagaaggtagaaactttacctgatcctaacagatctcatttagaaaggaatatgctaagcctggcatggacggtgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactagtcttctaatgaccctaacatatgtagcatatactataatttcattgttccaaattagtatttttaaagcaaaatgaattacctgtttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatcctctagaaatacaacctaattggcagtgagccgagatcgcaccactgcacccctgcctgggcgacagagtgagactttgtctctattacaaaaagaaaagaaaagaaatacaacctaagctcacctgcctgtgattcctcatttctcaccatcctgtgccagggtggctacttctctctgtgaggactcaaatacaagccaatgagtggcccactaagcttttaagatttgattttcctgccttgagataaaaaggagtgtaggtaaatgaaagatcaatgtatggaatatataaaaatacgaaagaaatatatacgtttaaaaatccataaagaaaaaaatctcattctaaacctgattaagttggctttttacgtaagtgtacaaataggatattcacagcatctttgtgcagtttttaaacttttatatttaaacattattaagttggcttttgttcacatgttgagtaatgggtagtaaattttctatatcagctcctggcgacagagcgagactccatctcaaaaaaaaaaaaaagtgacagtagtggaataaaattctaggtcttgtccaccagctcagcattcttttaatcacaccatgcttttctacaccctgcagtttcttcttagttgttcctatagcactcagttccttacttaaaaaaaaatggaaaatgctgaagaaggaaaaggcacaggatccaacagaatatggcaacttggaagatgacaacagtcagcagcaccagggagcaaaatggaaataattttgtttctttccttagaacattaactgtgggctttccaaaatttgtccttcaacttcatttctactttagacaggctctatttgaggtccatctcatcccctttcttcccattcccctccaaatactgctgcattaaccttgccttttcctttcacttcttcctctaatcctaaacttgatcattccctaaaaatctttttataatcccaatagtctttagaactagaactactcatctctgcatttgttcccaactttctcaaaagctcagtcccaaaatgctgcctcatattttttcatctttcatcactcctcaaccacatgtaatatgccccctgccccagtatttcataattgccctcaataagcccctccaattgcctggattccccagcaagcactttctaaataatactggtctcttcccaactaaaaaaataatactcatctgttgctatagactgaatgtttgtcctccccacaaattcatattctgaagtcctaacccctgatgtgattgtatcaggaggttgagctatggcagaaccctcatgaatgggattaatgcccttaaaaaagagcccagagagctccctttcttgccaccatgtgaggatacagtgagaagacagctgtctattagccgggaagcaggcccttgccagacagaacctgcctgaaccttgatcttggactagaactgtatgaaataaatttctgttgtttataagccatccaatctatggcagtctgttattgtagcccaaactgactaagacatctatactatcagatgtctagtcatcctctccagaagtctattcctgctttgctgcactctcaccaacattgaatataatttaattattctcaatatgataggtgaaatatctctcgttttcactttcctctcttgcagtgaggatggccatttgacacagttacagcaaatgagtcttaaacaggtatcactgactgggcttctgaagatttttaaaaagaaagtcaacactgctgccatgggcctcatgccctttgccctcccttctgcctgcctagagcctgtttgattcctcatcccaattaacccacacacactgactacattaatgtttctatcaccagctaggatcatgatgggtttcctggaaaagtcaaagacttcaggacagtcagctgtctacagaataaaatacagggtcctttgattaagacctcacaatatcacttttttccctatatttgtcaaggccattatacggcaaactccatttccaaaacatgccttctttggtcagatatcgtctgatagaatgatcaaaaggaataaaaacctacagaaaccatctaagaaaaatgaagactcactgaaaaaattcaagagaatctcacagaccctaaatataagaaataacggggggcctcggggggaatgagaagtcatttggcagctactctgctggcaccaattggagccctgctccttcaagtgtggtctggtaaccagaagtactggcatcgccacatcaccagggaacttcatagaaatgcagactccacacttactgcatatctgtaagacctcaggattcctttacacattcacatttaagaagcaaaaattaagagcacttcctcccttccacattaccttccctgtgtacagctgtattccccaaaaccaaaataaaaatactgaactgagcacacattataagctaggtatttgatatgtgttatctcatttaaacctcaacccacaagatagtactattacctccttttattattaacccattttcagagatgagaacactcaaataacctactcaaagtcacgcaaattaggaagcagcacagttgggactggacctcagaaaagtctcctctaaagactgtgcttttaagcacttctatctgtgtgaaaaggctgttaattctgtatcctccacactatgtgaataatgcttagaaatggcaaggaacccccaaactactgagtcccttaattttgtctgagaaaggcaggattccaaaattagcattgaagagtcagaatgaagggtttgaaaaaagatctgttcttggaattagacacaacaaactttgaagacagaaagataaggactacctatctctatgaatcatcaaaatttactcaaacttcactctgtatgactggccaataaacacagtatgtttatatgttgctaaagctggctttatgcctaaagtgctaaattccaacagagtgggaaatatgtacctcccttaccagtctggaggccctggaggcctgttcctgcagccagtggagatgagccccccagctcacttcctccctccagttgtgagatcacagcaggtttgagaagtggaaatcctggtttgggagaggtaaataggagagacagatgaataaactcccacagacaaattcctaagcctcttctcagactgtctcagcaatggggagggaaggtaagaaccccaggaggtcccaagcctcaggactacgggaaagtactgtggggcttaggaaggactaaagagaccttggagacttccaagggctttgggaggcaaatgtgggggttgggggtgaaggcttgggaacgtgtgggagagcctggttagggcccagactgtaggcctaggagacctcatgcagggcaagcagggagattctgcccaaagggataccactttttgaccttggcctgaaataatccagagtacactgagatccttgaaaagactcaagacaggtaagatgagggggcaactgaagatgccactgtggaacaggaagcaactggattccagtgtttccaaaacatagctttcatgggttggatcaacagtgcataccagttccaagcaaagtcctatataggcctacaaaaggcttggcatttgcccctgccagtaacctctaagtctagattaggaacagctctggggttctcactcagtaaaggattaccagagatcccctcagtaacctgtaagggagaagcaagccaggaaccccaattggcagattccaggttcccagggtagagaggtcttacccagggaggccacattcccataattctccagcatcacatccctgtacagggtcctctgtgcaggggacaggccatcccattccgcctgggtgaagtacacagccacgtcctcaaaggtcaccgacttctgaaacaataggttcctgctgccctagggccaattccatagctcaggccctaagtgaggggcagagcgcagtataagggcttggggagggtgcttgtgagagcacaaaattagtattaacaacaaggggaagatctcagaaaaaaaatatcgagaaagtaaactacaaagtatccacattctcccacagcagggaaacctcatgccatttttcacacaaataagaggtcacattaagacaggctgaaagaaaaaaatttccataagcaaattctctaaagccaactccactcttttagataagctgctccctcccagcaaactcggggctgatccaccagcaggtcccacaccactcccctgcgcctaacctcagccctgttctgctgcccaccccctgaactcccatttcagtggatc

SEQ ID NO: 2226 - DNA, 1456 bp, Homo sapiens
  Genbank Accession No. L76571
tgagcaccagccaaccaggggcctgcccatgccagggagctgcaagccgccccgccattctctacgcacttctgagctccagcctcaaggctgtcccccgaccccgtagccgctgcctatgtaggcagcaccggcccgtccagctatgtgcacctcatcgcacctgccgggaggccttggatgttctggccaagacagtggccttcctcaggaacctgccatccttctggcagctgcctccccaggaccagcggcggctgctgcagggttgctggggccccctcttcctgcttgggttggcccaagatgctgtgacctttgaggtggctgaggccccggtgcccagcatactcaagaagattctgctggaggagcccagcagcagtggaggcagtggccaactgccagacagaccccagccctccctggctgcggtgcagtggcttcaatgctgtctggagtccttctggagcctggagcttagccccaaggaatatgcctgcctgaaagggaccatcctcttcaaccccgataaagaaactgaagcccagagattaagtgacttgcccaaggtcacccagctaataagtgacagtgctgggattcatacccaggaagcctaattcttaaccattactccacactgcctcttcataaatggatggatgaatacattgaaaattgataaataaattacctcctctaaaggaggaggtagtagtgggacctcaaaggccgagcaaaggaggcagaggggtgtctctgatggcccagatcttgggccagtcttgtcctttggtggctgggagtagggtgctcaccagccctcttctccctctctgcccacagatgtgccaggcctccaagccgcctcccacattgggcacctgcagcaggaggctcactgggtgctgtgtgaagtcctggaaccctggtgcccagcagcccaaggccgcctgacccgtgtcctcctcacggcctccaccctcaagtccattccgaccagcctgcttggggacctcttctttcgccctatcattggagatgttgacatcgctggccttcttggggacatgcttttgctcaggtgacctgttccagcccaggcagagatcaggtgggcagaggctggcagtgctgattcagcctggccatccccagaggtgacccaatgctcctggaggggcaagcctgtatagacagcacttggctccttaggaacagctcttcactcagccacaccccacattggacttccttggtttggacacagtgctccagctgcctgggaggcttttggtggtccccacagcctctgggccaagactcctgtcccttcttgggatgagaatgaaagcttaggctgcttattggaccagaagtcctatcgactttatacagaactgaattaagttattgatttttgtaataaaaggtatgaaacactaaaaaaaaa

SEQ ID NO: 2227 - DNA, 2376 bp, Homo sapiens
  Genbank Accession No. L76687
cggatgagggtcagggctgcgcggacccctatcccgcctgcgtcctcccggcaagcccagcgggagcgcccgctcggctgggtccccgcctccagcgcgccggggccgcccagaccctgggctcagcctcgcgccccggtgcccacctgaggaggcggcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcgcgccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctaggcggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccaattacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagg

SEQ ID NO: 2228 - DNA, 8095 bp, Homo sapiens
  Genbank Accession No. L76927
ctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggctcctcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggtgaggggctgcacggggagcccctagcccgccgccgcctgtcccggtcgccgaggagggcgggcctcggggacgctgggggcgagttcttcccgcgggagatgtggggcgggcagctgcgcctggagcaccggtgcacggaagagtccccgggacaggctgttccccacgttggaagggaggaagcgaagaagtggtccccagagggtgcgcggccgcctcttggctcaagcccgccctctgggggctggggctcctcgccttcaacctgggagcatgttccccttaaactgtgaggccctgtgtgccacgcagaaggggacactccgcgcctccggccaccgtggggccccaaccgcagacctgggcgaacgtagccttctggcccagcccgttcaatttacagaggaggaaactgaggcctagagaggcccagtgaactgctggaggtcacacagcaggttcttggcggggctgcgacttgggagtgaggactcccagctttcagcggggggcgctttccgccccatctgcagcttggggagtgcacaggtacaggatgtccagagccacccaaaatgtaaaggctttggagctccagtgatctgttttccctttgggctaagctctccccccttgccccacagctcagggcagagtccaggtctgtgctccagctgcagccgccccgcccctgaagacctaagggggcagggctcaagcccccaaggtcagctggccctcaggatcttccctgcgacgctgaacctggaggttcagaacctgatgactgtggaggcatcagaacctcggctggaggcagtgtcattggagaggcttactccagctggcggaagcctcacgtactgcttgtctctcctgccaggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccaggtatggggcccaggcctgagccaagtcctcactgatactaggagtgccacctcacagccacagagcccattcatttgtctgatacactgtggggaaggcttgtagagtggagcatcccattgtacagatgaggaaactgatgcccccagaaggtcgggaacttgccctgggtttcccgtgacctgattggaggagccaggatttgaaccccagccttttttccctccagagccctaaaccaggaggacaattagaagtgtcccagcaacctcagagggtgggaaaatggaggggagtgggtcccttgggccagcaggttggtggggttcttgacaattgagacacacacctagaaacagttgctaggccgttgctgcccttcccgccaggacacctgcccttcctgtccaatcctcccaggcagcctctcttaccatcacctgttctttccccctgcagctgcccccctccctggcttcagtgcagtggtggtcagctcagtgcccctggggggtggcctgtccagctcagcatccttggaagtggccacgtacaccttcctccagcagctctgtccaggtaccagctaggccccagccctgacccagccctccttccctgaggtctccaggtggtcccagcttctactatgccttatggagggggtggcagggaatctccctggagtgtcattgaagccactgctgcttccaccagccctagcctccccacctcaccctgtactgcagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggttgggctcgctcccctcgtcccctcccgccctgcactcagcagctcctgggtggagtgtgcccactgcctggcgcagcaagcacacgcttggcctcgtcatctcccccattgtaactccaccccaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagagggtgagaactgccagggtgctctatcctggaggcggctgtgctccctgctggcgcctcagtgtggccttgaccctgcctgggaccccgatctccaggggcttctgccatgctctccccagtcccttcaaacactgcgcacccagggttccaatctcagcaggggtgcttgaaatcctaaaatggtcttatctaatcagaaaaatcatgtttccattgtggaaaatgtagaaaagtacaaagtagaaaataataagctataagggcactacccagagataggcactgctgacattttcacgtttcctttcagtatttttccacatctgtcttcaaagctgagtatatgtaatatatcatcactttccccccccacccccttttttttaagaggcagggtctcattctgttgcccaagctggagtgtagtggtgtgatcatagcttactgcaaacttgaactcttgagctcaagggatcctcccagctcagccttccaagtagctgagattacaggtgtgccaccatgcccggctaatttttatcttcgtaaagacggccttgtagtgttgcccaggatgatcctgaactctggcctcaagaggtcctcctgccttgggctcccaaagtgttgggattataggcatgagccactgcggccagcccatttgccgtgttttttttttggacacagagtttcggtcttgtcacccatgctggagtgcaatggtgcgatctcagctcactgtaacctctgcctcccgggttcaagtgattctcctgcctcagcctcccgagtagctgggactacaggcgcccgccactacgcctggcacattttttatagttctagtagagactggggtttcaccatgttggccaggctggtctcaaacgcctgacctcaggtgatcctcccgcctcagccttccaaagtgctgggattacaggcgtgagccatagtgccggtctcttttttttttttttttaaactaaacataatctcagaacccagaaccctatcttatcttatgccatgaaaggcatatctcggcgtggctctttttttttttttttctttttttttgggcgaggtggaggcttgccctgttgcccaggctggagtgcagcggcgcaatctcggttcactgcatcctccacctcctgggtccaaatgatcctcctgccttagcttcctgagtaggtgggattactggaacccaccaccacgcccagccaatttttatatttttagtagagacggggtttcatgttggccaggctggcctcgaactcctgacctcgtgatctgcccgcctcagcctcccaatgtgctaggattacatgtgtgagccactgcacctggcctccgtgtggctctttaaagctccacaatattttagcattcaggtgctctgtcatttacttaactattttctgatacacctcacactgcgattaactttccttatttatcttttttattatttatttatttatttatttgagacagagtcttgctctgtcacccaggctggagtgcagtggcacgatctcggctcactgcaacctctgcctcccaggttcaagtgattctcctgcctcagcctcctgagtagctaggattagaggcatgtgccaccacacctggctaatcttcgtatttttagcagagatgaggttttaccatgttggtcgggctggtcgtgaactcctgacctggtgatctgcccacctcagcctcccaaagtactgggatgacaggcatgaaccactgtgcctggccatcttttttattttttaaagagatgggttctgctaagttgcccaggctggacctgaactcttgggctcaagtaatcttctcacctagtctcctgggtagctgcaaccaaaggcacccggtttatctgcattctcttttttttctttgagactgagtcttgctctgtagcccaggctggagcgcagtggcgtgatctcggctcactgcaacctccgtcttcagggttcaagcaattctcctgcctcagcctctggagtggctgggactacaggcgtgtgccaccagagcgagttaatttttttttttttttgtatttttagtggacactgggtttcactatattggccaggctggtcttggactcctgacctcaagtgatccgcctgccttggcctcccaaagtgctgggattacaggcacaggcgtgagccactacacctggcctatctgcattctcttaatagtttcttagaaatggattcttaggagtaggattacagagtcaagagacacaagttttgtaggctgggtgcggtggctcacgtctgtgcctgtaatcccagtactttaggaggccaaggtgggcagattcattgagctcaggaattcgagaccagcctgggcaacatggcaaaaccccatctctaaagaaatacaaaaattagccaggtgtggtggtgtgtgcctgtagtcctagctacttaggaggctggggtgggaggatcaattgagcccaggaggttgagactgcagtgagctgtgattgcaccatggcactccagcctgggcctcaaagtgagatcctgtctccaaaacaaaaaagatacaagtatccttaaggctcctgctacacatggccaggaaggtagtctattggacagttttaaggtcattatcaatattagctcatttaattccctccaaaactctgtaaagcacattctgctaccatagttgtcatatttttgatgggggaatctacagtgagaggcagtgctgggatctgaaccccatctggacagattagctccagggcccatgctcttgactggctggccgcgctgcccacactgagttgttccttcctggcagggtaggtgtgcctatctcagggacactagacagctccgagggacctccctgtccttttcctttgtgaactgtgtcacgttctccagagcagggctcagacctgccctgcctgctctgtgcagatgcccttggccaaggttttcacactggaacaagttggtccctcctccccaccccagcctgtccttggccctcctccaggtctccttctgcataggagcagctcaccctgcctcctccagagtcctgccctagaagcgcaatccctctccttccatcccctgcctggctgcctggctccttccctcagcctccaagacatgctcagttttcttccctcctaaaacaccacccactgtctcatttccattcatttctttctttctttctttcttttttttttttgagagggagcctcactctgtcacccaggctgaagtgcagtggcatgatctccactcactgcaacctccgcctcccaggttcaagcaattctcctgcctcagcctcctgagtagctgggattacaggcgcctgccacgatgcccggctaacttttgtatttttagtagagacggggtttcgccatgttggccaggctggtctcgagctcctgacctcaggcaatctgcctgcctcagcttcccaaagtgctgggattacaggtgtgagccaccgcgcccacccattcatttctcagtcctttgaatctacttgcccctccatcccgccatgccacctaccctaacaaccttcccccttaaacctgcgggtttggccgggcgcagtacactgagtcagtactggtactgacccaggtacccctccagcctcagctccagtcagatgggacagcctgctggtccctggctgcttctgccccctcttctggagccccagccctggaggctccatgtggctcagcagaacttcttctcctcctgctctgtggtggcctcttgagggcagcactcaccttggaaagcatggagtgtttcaaccctcactgctccctgaaggaccaaggtgtcccattttacagtcgggggaggaggcactgtgataaaggggctcttcagacccacgtctgagagagccaggctgcgccgcccccgcggccttccacccttcaccgtccagccagggccactgccatcaccgcctgctggtcctcacaggcgtcggggccccaggcagtgagaaggcggctgctgactcctctttcctccccagctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcaggtgaggccctctgggcgccccgctcctgccgggcacaggccggcccaggcccaccccttcaatatcctctctgcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggtgggcgggcaccagggcctgggcgggcaggagcggcagcttcccggggccctgccactcacccccagcccgcctcttacaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtacctgcctcctctagaggtgggtgtatgcttgggtgtcagagaatgggggatgtcagaaccgctcccctaccctaggggagcacctctcaggccccagaagaatgggcaaggcagggcctagcagtagcaaaaccatttattaagtgcagaacaaaggctgggtccttgtgctgctcccagctctttggttacaaataggtttgggcccacagaggacggaccttgcccccttcatgcctcccaggagacacctagcccctgctctgtgcatgcgggtgggctgggcccccaggggtgcaaggatggagtagctgaggaggctccgggagaggagtcgggaggacgcctagtgggacattgcgggggtggcgcagggtgcggtcaagtttggaagaaactgttgggtcca

SEQ ID NO: 2229 - DNA, 1559 bp, Homo sapiens
  Genbank Accession No. L77567
caccgcggaccgagcgcggagttctggagtctcggacccgaagccgccacagggcgccccgcctcccgcccgccatgcccgcgcccccgccccgcgcgctctggcggccgccgcgcccgcgtccgggaaggccaactgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcagc

SEQ ID NO: 2230 - DNA, 1277 bp, Homo sapiens
  Genbank Accession No. M10058
agggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctggggcctcttctgctttctcgggaattttcatctaggattttaagggaaggggaaggatagggtgatgttccgaaggtgaggagcttgaaacccgtggcgctttctgcagttcacaatgataacctgcaaactgcagaaagcgccacgggtttcaagctcctcaccttcg

SEQ ID NO: 2231 - DNA, 1969 bp, Homo sapiens
  Genbank Accession No. M10098
  unsure (1)..(1969): n = a or c or g or t
ccgtccgtccgtcgtcctcctcgcttgcggggcgccgggcccgtcctcgagcccccnnnnnccgtccggccgcgtcggggcctcgccgcgctctacctacctacctggttgatcctgccagtagcatatgcttgtctcaaagattaagccatgcatgtctaagtacgcacggccggtacagtgaaactgcgaatggctcattaaatcagttatggttcctttggtcgctcgctcctctcctacttggataactgtggtaattctagagctaatacatgccgacgggcgctgacccccttcgcgggggggatgcgtgcatttatcagatcaaaaccaacccggtcagcccctctccggccccggccggggggcgggccgcggcggctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccctcggatcggccccgccggggtcggcccacggcctggcggagcgctgagaagacggtcgaacttgactatctagaggaagtaaaagtcgtaacaaggtttccgtaggtgaacctgcggaaggatcatta

SEQ ID NO: 2232 - DNA, 4340 bp, Homo sapiens
  Genbank Accession No. M10612
ggatccttccccagtgtggccagaaaaaaacccaccccactgcctcccaggaatcaatgagtagaagaggtgacacctgatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcacctccaacccctccacagcccccaacccagcctctgtcggaggcgaattctcagagtgagggttccctgtcacttgagagaaggtcccctgtgacgtgaccttgggggacgtcattgccctttctgtccccacccaccccctcggcagttctgttggccaggactttggcctagacaaaggatgggggttgtggctgtggagcggaagtgggtctcaaccactataaagcctctctgtgcccgtccggagctggtgaggacagcctgccagagtctggtaagaaagggactcagggtgcggggacaggggggcgtcaggggagagggcaaagatcgataagcaggaattttagaagcgacaatattagtagcccgtgttggaaccatgactgtgtgtgtgtgtgtgtgagagagagagagagagggagatggaagctcgctatgtacctaggctagactcaaactcctgggtcaagcaatcctcctgcctcagcctccccagtagctgggactacaggtgcaccaccacactccacaaatcacagaatttagaactgtagactatttgagcttctgcttagagttagggtggctgaggtggggaggatcccttgagcccaggagtttgaggatgcagtgagctgtgatcttgccaccgtgttccagcctgggtgacagagaaaccccatttctaaaaaagagaaagaaaaagggataggtacaatggctcatgcctgtaatcccagcactctgggaggccgaggcgggtggatcacttgaggtcaggagttcgacaccagccttaccagcatggtgaaaccgcatctatactaaaaatacaaaaataagccgggtgtggtagcatatgcctgtaatcccagctattccagaggctgagacaggagaattgcttgaacccaggaagcggaggttgcagtgagccagattgtgccactgtactctagcctggtgacagagcaagactcagtcttggcgggaaaaaagaatggaaaaatttaaaaaactaaaaaaagactgtaggctggggctggtggcttacacttgtaatccaaacgctttgggagccaaggcaaacggatcacttgtgatcaggagttggagaccagcctggccaacatggtgaaaccccgtctctagtaaaaacacaaaaattagacaggcatggtggtgcatgcttgtatttccagttactcaggaggctgaggctggagaatcgctcaaacccggaagacagaggttgcggtgagccaaaattgcgccatcgcactccagcctgggcgagagaacaagaccttgtctcggaaaaaaaaaaaaagaattgtcgaccatttgcttgtgttctttctccgggaatacagatctcaccctctttctgccgtacttcctcatctcctacgtgtggatgatgatattgtgccctgtgcatgttcttcgtcaccaaaagtgcctctctcatagagcaggtgagaactcagtgaggagatgcagggacatgaggtctgacttagggcagagccctaaggtaacacatttgatctactgtaggtccttaatggtgtctgcagagcacctccctgcactgactcagccttagcaaagggcagaggctttgctgtgttcctgctgggcccagaactgtttaggtgctgcaagaaagccttctaggtggggtcagtggctcacacctgtactcccaggaccctggggaggccgagatgggaggatcgcttgagccccaggagttccagaccagcctgggcaacaaagcaagtctcccatctctacaaaagaataaaaattagcagctgggcatggtggctcacgcctgtaattccagcacttttggaggccaaggcaggcaaatcacttgaggttaggagttcaagaccagcctggccaacatggtgaaaccccatctctactaaaaatacaaaaatcaggtggggcacagtggctcaagcctgtaatcctagcactttgggaggccaaggtgggcggatcacgaggtcagaagttcgagaccagcctggccagcatggtgaaacccatctctactaaaaatacaaaatattagccgggcatggtggcaggtgcttgtgattccagctccttgggaggctgaggcagaagaattgctagaaccctggaggcagtgggtggcattgagcccagaatacgccactgcactccagcctgggtgacagagccaaactccatctcaaaaaatacgaaaaatcttcagccgggtggtggcgggtgcctgtaatcccagctactggggaggctgaggcaggataattgcttgaacctgggaggtgggggttgcagtgagccgagattgcaccactgcactccagcctgggcaacagatgaatccatctcaaaaagaaaaaaataataattaaatgttgaaaatcagtagtagatgcacagaaatgttgaaaagtgaggcccaagaagggggctgtgtccaagtccatgcatgggaaacttgactgggaaaccgagcacacacagagcaggatctcagtcccccccaccagagggggctgtgaccacaggaacagccgcctccagtcagcctgccacatgacaccccctcaatgttccaggtctctggacactatgggcacacgactcctcccagctctgtttcttgtcctcctggtattgggatttggtgagtgtgggcttccggggagggaagccttggggaggggaatgagctccaagcatcttcccagcccaggcccttcttacctctgcctctgccctctcctcttcttccttcctcctttccccctgctgcagccccaccccttacctgacacactctccccctgcagaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggtagcacctgcccctggagaaatggggtctggcccataccaccacgactgcatccaggacccagaagttcaggccccagcccctcctccctcagacccaggagtccaggcctcagcccctcctccctcagacccaggagtccaggcccccagcccctcttcctccctcagacccaggagtccaggcccccagcccctcctccctcagacccaggagtccaggcccccagaccctcctccctcagacccaggagtccaggcccccagcccctcctcccctctaaccatctgtgctttctccccagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatgccactgcttttctgaggattcaaggcccaagatggaggggctgactcagtccagccaacatttaatgagcacctactttatgtatggagctctaacccatgggtccatgggaataaagcagtgaatagtaacaataaataatcgtaacagcaattagagactaatctttattgaaatccggctttctctattttttttttttttgagacagggtttcactctgtcagggaggctggacagcagtggtgcaatctcggctcactgcaccctccgcctcccaggttccagcgattctgtgtgcctcagcctctggagtagctgggattatgggcatgtgcactgtgcaggctaatgtttgtatttttagtagggttttgccagttggtaggctggtctcaaacttcttgaccctcaagtgatccaccgccttagcctccaaacttcttgacctcaagtgatcca

SEQ ID NO: 2233 - DNA, 1763 bp, Homo sapiens
  Genbank Accession No. M10942
cccgggacggcagcaggtgggctgcacacggactctgggacaagtcgagctgaaaaccgcggagcaggggtggggtggagacgcccgcgacgccaaggctggggtcccggaacacgctgggaggagggtggaaggcaacctcggggaaactgggaaaggcggcctggacttcgggaacaccgcgtacctgcgggggcacagcccacccgagcgaacgggctccaaagggaaggtcccgcggtgcccaccggcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtgggaccttcctggtgcggtaaaacaggagggtccttgccccttccccagcgttagtgagaggacatggggcttctgttcctctgtcctgagtgggaaaggagctctgagggctggccctgcacagaggagggggcactggagactcactgacccactgctgtaccttctgcatctcactcactgcccactgcgttttcctcttccttgtaggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaatcttactccctgttcttct

SEQ ID NO: 2234 - DNA, 1935 bp, Homo sapiens
  Genbank Accession No. M10943
tctagacagtggcgcaagagactggggttgcactgggactccaggaaaggcttagctgttgacgaaggaccggggcggggccggggggcggggcgaaggccaggatctccaggtacccggaaccccaaggggcgggtgtagcaggcaatcttggcgaaactgggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggccccctcccctgactatcaaagcagcggccggctgtttgggtccaccacgccttccacctgccccactgcttcttcgcttctctcttggaaagtccagtctctcctcggcttgcaatggaccccaactgctcctgcgccgctggtaaggaacgccgggttccgtgcctggggatgctcgattcccagacaccatagagagtgttcctgggtttgagaaggtcgtattttgagatctcaactgtaggggactccttgacttagtccagtgctttcctcttggccaagatcctgagagcatttccttcctctctgtgcctctgtgtcagcgttgagggtactgaggctcaaggctgtcctgctccacgtcatgcggtttgtcccagggctgttggctgagccccagtgctctgaccaggctttgagcagcaggattagataggaggcaggggacattgcctcttcggggttcaggacagaaagtcgaagtcgccgtcttcccaggctgtgcctggagcctgggactttcctttggagtgcaaacaggaggctgcttggccttcccagcatgaagggagaggacatggggcttctcttcctctgctctgagtgggaaaggagctctgagggctggccccgcacagaggagggggcaatggagactcattaactcactgctgtacctcctgcaggtcactcgccgctcactggcttttttttctctttctcgcaggtgtctcctgcacctgcgctggttcctgcaagtgcaaagagtgcaaatgcacctcctgcaagaagagtgagtgtgaggccatctccatggtctggggctgtggctaaggttgggatggaacccaaggctggccctgagtgcatgcttctggggaactggccttcctttgtccccgtaggttgtcactgcctttctagtcttctgccctgtgcagggcgcctgggcagctttctcataggaagacccaccccagatatttcccagttgtctcctgacaaagccataccctcctgaactgagggtcctttgtggctggaggctctgttgggggcctctgttggggagggaggtccctgggcaagttggctgtgacctctcatgctcctcttcttccccaggctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgattctgacttcagtttcccttatgtgcttcagaaatcagagactggggtgggggatcgaactagggttgcagactcctgggctctaaatggaaatctgagtccctaacaatcagagtgcattaaggcaagccaggctgcctcactgtgcttcctcttctgtagaatggaataacacttcatcaggtcattggtggggatcc

SEQ ID NO: 2235 - DNA, 1309 bp, Homo sapiens
  Genbank Accession No. M11025
gccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 2236 - DNA, 4577 bp, Homo sapiens
  Genbank Accession No. M11313
gctacaatccatctggtctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaacgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttttattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggggtggctgaggtaggagtaacagtccctgacaccatcaccgagtggaaggcaggggccttctgcctgtctgaagatgctggacttggtatctcttccactgcctctctccgagccttccagcccttctttgtggagcttacaatgccttactctgtgattcgtggagaggccttcacactcaaggccacggtcctaaactaccttcccaaatgcatccgggtcagtgtgcagctggaagcctctcccgccttccttgctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagccgccacatttaccaggactgggaaggctgcacaggtgactatccagtcttcagggacattttccagcaaattccaagtggacaacaacaatcgcctgttactgcagcaggtctcattgccagagctgcctggggaatacagcatgaaagtgacaggagaaggatgtgtctacctccagacctccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctcaaaccagccatagtgaaagtctatgattactacgagacggatgagtttgcaatcgctgagtacaatgctccttgcagcaaagatcttggaaatgcttgaagaccacaaggctgaaaagtgctttgctggagtcctgttctctgagctccacagaagacacgtgtttttgtatctttaaagacttgatgaataaacactttttctggtc

SEQ ID NO: 2237 - DNA, 1776 bp, Homo sapiens
  Genbank Accession No. M11321
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccaaggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaacc

SEQ ID NO: 2238 - DNA, 2482 bp, Homo sapiens
  Genbank Accession No. M11437
ttctgtttagatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccatacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttctctttcattttaaatattgtctgttcttttaaataaacaaccacagatgtcaggaaaaagtcttaccttgtcaactggttgctccactttttaaaaatgatgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagca

SEQ ID NO: 2239 - DNA, 4668 bp, Homo sapiens
  Genbank Accession No. M11567
tgtttgcattaagttcatagattataatttgtaatggaatcaacaccaaatgcaaattagaaagagagcccactttgctcacccagtcacgtcttcccatgtaaccatagaacgttggggtcctgtgtctttctagatccacagtcttgctctcagaacaggctagccacaccacaggcctagtgccaggacccatggcctttttttaagctcagactcccttctgtgaacagcaatatccccacaacttgtacaacattggtgcttcctgcaagggctacagaactatttgatacgaaaatgttcattgacttacacacaagagaagcacaaaataaaaaattaataattaatttaatgtctttgaaaatgtaccatttatttttacatttggggtcataagaattgtattacacttaagaatgcaatacaatttgaagatcagatttttctccctttgtgagaatttctcagtatgtgtgatgactaccaagaaatcatagccagtcataaattcagtgagttactcataaacgaacaagaaccacctacttcttggggaggtaggtctgcttcccttcaactcaggatacaactgctttcaactgctttcttcacattagctgactaattagctagaagcctgtcgtaaacaattttatggttgactccttccctgggctcagggttccctagaacagagaggtccccaaatcccggtctgtggcctgtccgcctaagctctgcctcctgccagatcagcaggcagcattagattctcataggagctggacgcctattgtgaactgcgcatgtgcgggatccagattgtgcactctttatgagaatctaactaatgcttgatgatctatctgaaccagaacaatttcatcctgaaaccatcccccaccaatccatagaaatactgtcttccacaaaaatgatccctggtgccaaaaatgttagagaccactcccctaaaactctcttcttagctctcacctcctgtattactatctcatctcagtacattgaagcccccatcttttccccatggatgcctcatttcctattagggaggcatttttttattttttgtttttatttttttccgagacggagtctcgctctgtcgccaaggctggagtgcagtggcgcgatctcggctcactgcaagctccgcctcccgggttcacgccattctcctgcctcagcctcccaagtagctgggactacaggcgcccgcactacgcccggctaattttttgtatttttagtagagacggggtttcaccgtggtagccaggatggtctcgatctcctgacctcgtgatccgcccgccttggcctcccaaagtgctgggattacaggcgtgagaccgcgcccggccgtcatttggtatgtcttaatgtgcctcaggacctagcacagtccctggtacccagtagagacctatgtaatgttcgttattcaataataaatacatgaattaaagagtgagagtggattttgtaatgttacgactgatagagaaatactcagtgattctaagggatggggaagaacggttggagctagaggttgtgctcaggaaactattaaatagacgttccgcaggaagggattgacgaagtgtgaggttaatgaggaagggaaaatagaatataaaatttggtggtggaaaagatctgattcatgatgccgtgtcagagagcaaagctcctgtccttttggcctaatttggtgatgctgttcttgggtctaccacacctccttttgccctccgcaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaatcagagtcttctcactgattctgggcatattgatctttcccccattttctctacttggctgctccctgagaggactgcataggatagaaatgcctttttcttttcttttcgtttttttttttttttttttttgagatggagtctcactctgtcgcccaggcttaagtgcaatggcacaatctcggctcactgcaacctctctctcctgggttcaagtgattctcctgcctcagcctcccaaatagctgagattacaggcatgcaccaccacacctggctaatttttgtgtttttagtagagacagggtttcaccgttttggccaggttggtcttgaactcctgacctcgggagatccgcccaccttggcctctctttgtgctgggattacaggcatgagccactgagccgggccactttttccttatcagtcagtttttacaagtcattagggaggtagactttacctctctgtgaaggaaagtatggtatgttgatctacagagagagatggaaaaattccagggctcgtagctactaagcagaatttccaagataggcaaattgttttttctgtcaaataataagctaatattacttctacaaatatgagaccttggagagaagtttccaaggaccaagtaccaacataccaacagattattatagtttctctcactcttacacacacacacacacatatacacatatgtaatccagcatgaataccaaaattcattcagggtagccaccttttgtcttaatcgagagataattttgatgtttgaatggaatgctcccaggatattctcttgtcatggttattttatataaaattcaaaaaccaattacattatttcctctgtaatcttttactttatcaactaatgtctggcaagtgtgatgttttggggaagttatagaagattccggccaggcgcttatctcacgcttgtaatccagcactttgggaagctgaggcggacagatcacgaggtcaagagatcaagaccatcctggacaacatggtgaaaccttgtctctactaaaaatgtgaaaattagctgggcgtggtggcacacacctatagtcccagctactcgggaggctgaggcaggagaatcgcttgaacctaggaggcggaggttgcactgagccgagatcacgccactgcactccagcctgggcgacagagcgagactccatctcaaaaaaaaaaaaaaaagaaagatcccagtttatcccagtttatcccttattcttcctcaattctcaagatttgtttttaagttaacataacttaggttaacacactctttgtaaaatacactgttcaatctacagactcagtggttagcttcctgttaactaatttctgttgacaggtacttggatattttatttagaaagtggttgccaataaattagttataagtcgccagtttcactgccttgtgaacacataattattgtggtctcagtattccctatggtggcttctcctgctcctggtattgccctgaaatgggccaaaagccgtggctccccaatgctcaggttatagaacattgtccaggtaccacctaggagagcccagcctcactgaaagtattcaaatttaggaatgggtttgagaagtaggtagctggtatgtgcttagcacaagaatctctcttccttgggttagtctgtttcaaaactgaaaacactgtcattccttaagaaaataggaaaaagtattccaaacctctgtcactagaaaatttgccatattaccaaatctcaaaaacctctcaggaaatgagaaagtcccagtttctggtaaactatttgggcccttttctcaagttctccttccagtgctatttccttgaggtgaggcaaagttactcaagatcatcgctgccactcaaggccttgatagggcaagtgaaaggcatggaccattattatattgatcacagcataagctgtgaaaacccacatcttctccaaacatctgcttggagcattatcatcgcatagtttgctctggtgttcagggaaatcgctgtttcataggaaatcacatggcagtgggatgggagtgtttcctgacctgccgatggtactggcacctgagcaagcattcctagtcctttttggtctgggcctcttgttctatcacaaccacaagctgtttaaaataaaaacgtcaagtcacaggcaggtcattttatcctgcgtgaatcaattgaag

SEQ ID NO: 2240 - DNA, 2806 bp, Homo sapiens
  Genbank Accession No. M11749
ggatccaggactgagatcccagaaccatgaacctggccatcagcatcgctctcctgctaacaggtacccggcatggggcaggactggggctccaggcgccctggcttccttccctccagagaagcagcttctccctcacagtctcagaaaagcgcaggtgacaaagagagggctctttttcatcctgaagtcagccgatccaccgcgctgatattctgacggcctgaggtggtttttggaaacacagtttgctgagccctccttcacactattgaactagaatccccaactgagaacccaggaaccagcatcaactccctaagatctcctgtccttgaaacacattgataggatccaaggctcaagcagagtggggagggaggctggggtctgcaaaggagaagtgggatccctggggtggggaaaggcactcagagagcagaccccggtcccctccctagccaggcccatctctccacttcaggtgggtgggaggcccctgtgccgcaggcccctccagtttgaaggaggcactgctggtgccagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaataccacatgaaggtcctctacttatccgccttcactagcaaggacgagggcacctacacgtgtgcactccaccactctggccattccccacccatctcctcccagaacgtcacagtgctcagaggtgagacaagcccctaacaaggtcaagtgagctgggagagccaggctcggggacagcaggcagttcccttggctggactagagaggagaatagccccataacgctctcaccctctcccaactgctgcctggtcaactggggaaccattgccttcggtgtgaatggggtgaagagctcagggccagacaggcagagcagtgtggttccaccagaactgtgggcaaggcctttggcccctaatcttccttctcccagcgggaaacagggatgacaccacctccctcagccagttttcttgtcatgatgtttagtaaggttttcataagatgatatgtgtgcaagagatcagtaatctgcaaatgggaaagatggctggttctgtgagaccaggctgttcctggtcccagctaagacattgcagtacccacctcccaaagggagtacacccttgctttgggcctgtgcctgcctgagtcctgatccgtcttccttcctaccctgcccccggcccccttctctttctgcagacaaactggtcaagtgtgagggcatcagcctgctggctcagaacacctcgtggctgctgctgctcctgctgtccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgctgggcctagcacggacatggtctgtcctgacagcactcctcggcaggcatggctggtgcctgaagaccccagatgtgagggcaccaccaagaatttgtggcctaccttgtgagggagagaactgaggatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgctt

SEQ ID NO: 2241 - DNA, 1044 bp, Homo sapiens
  Genbank Accession No. M12125
tgctgctctcctcccgctccgtcctcctcgcctgccaccggtgcacccagtccgctcacccagcccagtccgtccggtcctcaccgcctgccggccggcccaccccccaccgcaggccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctc

SEQ ID NO: 2242 - DNA, 539 bp, Homo sapiens
  Genbank Accession No. M12174
cgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgccgtcgcgcctgcccctgccggc

SEQ ID NO: 2243 - DNA, 1486 bp, Homo sapiens
  Genbank Accession No. M12272
gaattccaaatgcactcaagcagagaagaaatccacaagtactcaccagcctcctggtctgcagagaagacagaatcaatatgagcacagcaggaaaagtaatcaaatgcaaagcagctgtgctatgggagttaaagaaacccttttccattgaggaggtagaggttgcacctcctaaggctcatgaagttcgcattaagatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaaggctaaagagttgggggccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtcccgaaacttgtggctgactttatggctaagaagttttcactggatgcattaataacaaatattttaccttttgaaaaaataaatgaaggatttgacctgcttcgctctggaaagagtatccgtaccgtcctgacgttttgaaacaatacagatgccttcccttgtagcagttttcagcctcctctaccctacatgatctggagcaacagctaggaaatatcattaattctgctcttcagagatgttaaaaataaattacacgtgggagctttccaaagaaatggaaattgatgggaaattatttgtcaagcaaatgtttaaaatccaaatgagaactaaataaagtgttgaacatcaactggggaattgaagccaataaaccttccttcttaaccattcaaaaaaaaaaaaaggaattc

SEQ ID NO: 2244 - DNA, 1157 bp, Homo sapiens
  Genbank Accession No. M12529
ccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaagtcacccaagaactgagggcgctgatggacgagaccatgaaggagttgaaggcctacaaatcggaactggaggaacaactgaccccggtagcggaggagacgcgggcacggctgtccaaggagctgcagacggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatcccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagtcggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 2245 - DNA, 1744 bp, Homo sapiens
  Genbank Accession No. M12625
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagct

SEQ ID NO: 2246 - DNA, 1259 bp, Homo sapiens
  Genbank Accession No. M12712
ctcacgactccgtgactcctgaaaaccaaccagcatcctacccctttgggattgacacctgttggccactccttctggcaggaaaagtcaccgttgatagggttccacggcatagacaggtggctccgcgccagtgcctgggacgtgtgggtgcacagtctccgggtgaaccttcttcaggccctctgcccaggcctgctgcaggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatcctccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagccactagagccttttccagggctttgggaagagcctgtgcaagccggggatgctgaaggtgaggcttgaccagctttccagctagcccagctatgaggtagacatgtttagctcatatcacagaggaggaaactgaggggtctgaaaggtttacatggtggagtt

SEQ ID NO: 2247 - DNA, 2088 bp, Homo sapiens
  Genbank Accession No. M12759
  unsure (1)..(2088): n = a or c or g or t
gtatactcattaccaaaaataacaatatctgcatttcattgttttaactttgttttctttcttttcttttagtgttcctctgaacaacagggagaatatctctgatcccacctcaccattgagaaccagatttgtgtaccatttgtctgacctgtaagatatatttttttccatagtaatatagatgtggaagttaatagcttttaattttaaccttgttagtaagaatgtttttaaaaatatgttggagtataaacatttacaaacataatctgaacttttgaatacattaattcctatgttaattattaggtatcataaattcataaaactttgtcacagataaaatttagctatacattttttctaaagaaaaaatcattggcattcatagaaaggccaatttctcttaatagttcaataagtgnatttgatcttataaaaaggcaggtgtttctttggaaatgacagactccaacatcaatttttttaaaaattctccctttcttgtcactataaataacttgtttagacagatatacagttgggaataagcctaacacagtagaaattgctgtatggtgtagataaaacaatcatattatcatatcattaattatattgcttactttcaactaatatatattaaagattggaaaatcccataagctattctgtattgtagagctgcttatgtctgaaaggagtcatcccttgctgtcatgtcagagctgcaagaactaattgattttggattgaaatgtgtagtcacattttgagacagcatttgaggggattgtctaatacatatatttgcttttcagctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttgggtgatgtaaaaccaactccctgccaccaaaataattaaaatagtcacattgttatctttattaggtaatcacttcttaattatatgttcatactaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgcttttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcatatacctgtgtgaaataaattgttggaaaaaagtttccttatgttaactttctttacgtaagttaacttgttattgatgaatggtttgtaagtatgatgtaatgaagcattaatcacagaactaatacatgtacatatttgaggtggctttgccattttatacccataattaaataaaagggcaaaatcccccctgataaataccatgtttatcatggcacataaaactttatggcagtttccaaggccaattgacatatatatttaaa

SEQ ID NO: 2248 - DNA, 1450 bp, Homo sapiens
  Genbank Accession No. M12963
gatgcacttgagcagggaagaaatccacaaggactcaccagtctcctggtctgcagagaagacagaatcaacatgagcacagcaggaaaagtaatcaaatgcaaagcagctgtgctatgggagttaaagaaacccttttccattgaggaggtggaggttgcacctcctaaggcccatgaagttcgtattaagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtgataaagtcatcccactcgctattcctcagtgtggaaaatgcagaatttgtaaaaacccggagagcaactactgcttgaaaaacgatgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcaatgttgccaaggtcaccccaggctctacctgtgctgtgtttggcctgggaggggtcggcctatctgctattatgggctgtaaagcagctggggcagccagaatcattgcggtggacatcaacaaggacaaatttgcaaaggccaaagagttgggtgccactgaatgcatcaaccctcaagactacaagaaacccatccaggaggtgctaaaggaaatgactgatggaggtgtggatttttcatttgaagtcatcggtcggcttgacaccatgatggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaagtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttctt

SEQ ID NO: 2249 - DNA, 2267 bp, Homo sapiens
  Genbank Accession No. M13143
ggtagtagcaaatattcaaatgagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcacaagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctgctgaagcccgctttcagcacgccgtaaccaggggctgacaatgcgaggtcgcaactgagatctccatgactgtgtgttgtgaaataaaatggtgaaagatc

SEQ ID NO: 2250 - DNA, 2051 bp, Homo sapiens
  Genbank Accession No. M13149
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaacaaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgccccagacaccatttccccagacaccccaatgtctttggattctgcagagcagatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccccgtcccttccattgcagacaaattggatctgtgtaccgactccctcctctaagaaaaggtgaggtgctgccacttcctgaggccaattttcccagcttcccattgccgcaccacaaacatcctctaaagccagacaatcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactat

SEQ ID NO: 2251 - DNA, 2462 bp, Homo sapiens
  Genbank Accession No. M13232
tcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 2252 - DNA, 1801 bp, Homo sapiens
  Genbank Accession No. M13690
gggcagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaggaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctcgaggatcaggttagggcgagcgcacctctccagcctcagctctcagttcgagccctgctgctgcctgcctggacttgcccctgccacctcctgcctcagtgtccgctatccaccaaaagggctcctgagggtctgggcaagggacctgcttctattagcccttctccatgccctgccatgctctccaaaccactttttgcagctttctctagttcaagttcaccagactctataaataaaacctgacagaccatg

SEQ ID NO: 2253 - DNA, 3321 bp, Homo sapiens
  Genbank Accession No. M13699
atgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaagctggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagagactggagcat

SEQ ID NO: 2254 - DNA, 1215 bp, Homo sapiens
  Genbank Accession No. M13829
aagaaccttgggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgccgtttatgggcttcatgacccggccgggagttgccatcatcacacagtggtgtgagggctccagcctctaccatcacctgcatgtggccgacacacgcttcgacatggtccagctcatcgacgtggcccggcagaccgcccagggcatggactacctccatgccaagaacatcatccaccgagatctcaagtctaacaacatcttcctacacgaggggctcacggtgaagatcggtgactttggcttggccacagtgaagactcgatggagcggggcccagcccctggagcagccctcaggacctgtgctgtggatggcagctgaggtgacccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacctaggccgatgagttgcctgcctgcctactcagcgcagccgccttgtgcctttagccccgcccaagccaccaaggagccaatctcagccctccacgccaaggagccttgcccaccagccaatcaatattcgtctctgccctgatgctgcctcaggatcccccattccccaccttgggagatgagggggtccccatgtgcttccagttcttctggaattgggggacccccgccaaagactgagccccctgtctcctccattatttggtttcctcttggccttggggatacttctaaatctcggagctctccatctccaatggc

SEQ ID NO: 2255 - DNA, 5985 bp, Homo sapiens
  Genbank Accession No. M13934
tcgtactgtcgcttaggccgacccgctcgcagcgacaaccagccctctacctcttttcgctctcccttaagtaataaaccgtctttccttatgacgagtcttaaactctttgggaggaataatgccggcgtcttccggaacccgacctcgccccgtgacctcagaggtatacttccgggacacggaagtgacccccgtcgctccgccctctcccactctctctttccggtgtggagtctggagacgacgtgcaggtaggagcccgggcgcgacaatcggggggcatctgcggcgaggggacctgtggggcttgggacgagagacgggggtctttccgtgggaaccgagctaggtgccgggcaagagacgcgcggctggcccacctggatcctggccaactcgggattgagttcattcctggtctcagaaggcccgttttgcttcagggaggagcttgtgaagtaagggtgagcgtggtccagccttttaagcctcggccccgcaatacggcggcacggccgcgtttgagctgcacagcgtagttgagggaacccgggacagacgtgggctcccgctctacctcgccaaacttttttcttggtgatcgcaggcccacgctaatctcgtttgtttcctcgtctgcaaaataggaataacaatagcaccgatcccatggtttgtagtgatcattcaaagaaggaaagcagggaaactctcgcactatgttggatgcttctaaatctggcgattctttgcgttgctgagtcgggcacgttgcaagttctggcgctcaggcccagcaccaatgtttgctgtcgcttgccctcgtttgatatactcctgatgaccactctgctcgttactttagggatgttagaacggagaaactgcaaattggcatttactgaatggccatcatgccgaaacatactcatgcttacgtatttgagatatgctggagcctttctatgcttctcgaggcagaactttgggcttctctcctgtggcgcgttccttacaatagttaacgcactgggtcgtgctcattggtctgatttgaagataggaacatttaacttcgtacacccaagacttacacttgaagtacttactgtggtcacacacttaactgaaagtttatatagggaaggcagaggagagatctaggaacacctgagacagactagggtaagttatttgtggtgtagaggcatcttgccactgtctttactgtgaccataggctgagacactctctatcttcaccatctgcaggatatcgattagtgttagtgtcttctgaaaatgttaaattgttctgaacaccaggaggttcagaaggcctgggctttaggcggaagcagtcttatcctagccttccactttctcattcattctcacccgccttcctcctgtcagtttctctctcccttagatcttgtgacagtatgattgcaattattatgcaaggtcataataggttagagttattttagtctcaggacccatcagatttctgagatgggtcttttccattagcctgccttttggatatattttagtgcctttgatatttgatgttggtgacaaagatttagttctaaatagttgtgggagtcaaatcagttgcatttttgaacattttgaagggatcaggtggagcacaggaaaacaggagatgagaggcttgagggctgtgttggtaagggacccttgaattctaagctgaggagttcatgcaggaatcaagcagctccctcgccccatgaaggtgttaggaatggtaccagtacatgggtagctgttggtcttgggtttcttcttgccttttggggtgcagccttcagcgatctgctgctagatccctaggcttctatcttgtaggtgctgtgagctgagctgttggtagtttctggggaaaggatacttctcatggtactttgccatatggccacagttgatacccccccaagtgcaaggagaaagaagttttagtgaggcagaaatgagagattacagtagagtattggatggagagtacagggacataagcaggactagggtttcatttaatagccagggaaagggatttctgaaatattttgtctgttaaccttatttcttttccttccactcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggtaatggctgggacgggctagcagttcaggggattctctctaaagaaatccctgttttgtccaggtaagaaaatgtgcttgtccatttagcccacaaatattgtgatttcccaggggttacaagagaggagacacattcttcgtccttaacagcgtgatggtcattgaatccttggtttcttgggaattatcttctttccctagttccctttgcagagcagcatggactgcaatgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagcttatattggccatcaaccccactgactaactccatagagagcccatgaccatcatcctccaccatgactgagctgtgttgctcttcactcattaggatatcgtaagcattccttgttggacgaggaagaaatgaccctgtgcttttgtccccagagaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggtacgagtcgcagaggggatggctgggtggtagaaaacctgctgggcttgggtgctggagcacctggatttgaggtttgggttttttgttgtgaccttgaacaagatattttaggcatatacatacttaataattggctcctgtgtacaccagcagctcagtgttgagcaccactgtatactaggagctgtgtttcaggtactagaagagagtgatggggaaacagacatggtctctaccctccttgtgtgggaccgaggctggtgggagagtcagactttaaacaacagagctccagggagtatgtggttttcatttgtgacaaatgccaggaagcacaagtaaggagctggtgataaagtgtaatttaaactagggtctaaatgataagtccggagtccttccagtgaaataaggacaagaggaggtattccagctagagacaactgcagggaaaggtcttgaggtgggggtgaacctgggcactatgaaggaaagagtggcatgaggtgcagtcagaggggaagaggtggagtcctgtaggagaggggaaggacctggatttgagtgatgggggcatgaaagctaaatagatgactgttgcgtgaacaagccagacatggtcagaacataacaacaaaccatatggccccctcagcctaaaatatttactgtctggctttttttttttcctcttttttgagacagggtctcactctcacccaggctggagtgcagtggcgctatctcagcttactgcagtctctggctttcaggctctagcagtcctcccacctcagcctcccgagtagctgggactgctagtagtagtgccaccacgcctggctaaattgtgtatttttgtagagatggggtttcaccatgttgctcaggctggtcttgaactcctgagctgaagcagtccgccctgccttagcctcccaaggtgctgagattatgggtgtgaaccactgtgtacagccctgtctggctctttacagaaagtttgcagacctctgaactagcggggtgttgggatcttagaaagaagatcttccattacttgccaaaggctcttcttaacttaaaccttcattttctaggaccaagacccctggacctggggcccagtcggccctcagagcccttgcccgctcgggtatgaagatcgggcggattggtaagtgcccccctctagctaatgcttgggtttattttgaagcattggccccaaaaagcacgtgctgtcccagtggatgtgcagcggctggtctggtcacttttggcagttaagtttgttaagggaggctgcaagaggcaccttgtgacttaaaaatctctcccctgaatatctctgtcaccttgatatgcaatgtcctgtttcatttgtgaatctctgtcctacactgcctgtgcagtaaaactgacaagagatgaattgtcctttcctccattcttaggtcattgctattagcatttttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcctactgtgtcctacttgaaggatgattttgttttcttgagacagtgtctggctctgttgcgtgggctggaattcagtggcacaatctcagctcactgtaaatttgcctcgtgggcggatctgtccaaaggatcctcccacctgcatctaccgagtagctgggacaacagtgtgtgccacacgggctttttttttttttttttgtagcggggagtttcaccatgttgcccaggttggtcccaaactcctggcctcaggcgttccaccagccttagtctcccaaagcccaaagtgctaggattacaggcatgacgcaccggcgcccagccttaaaagattttttcagactttttttcagtgtctttttacttaatgaaaacgagacagttgcagttaccctgtctagaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccgcttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagtcttctctccttcatcaggggctactcaggcattttgatttcttcctcctatttggcttcttggagaagagcctgagagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctc

SEQ ID NO: 2256 - DNA, 2493 bp, Homo sapiens
  Genbank Accession No. M14058
ggatcgatttgagtaagagcatagctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcataatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaaggcccctttctttcttctgaggattgcagaggatatagttatcaatctctagttgtcactttcctcttccactttgataccattgggtcattgaatataactttttccaaataaagttttatgagaaatgcc

SEQ ID NO: 2257 - DNA, 1872 bp, Homo sapiens
  Genbank Accession No. M14091
ttcagaaaaaaagtgattcaatttccataaatttaatttactcacagcgttttcataatgttgctataacatctgaatgacagtccatggcatattcctggttgcagcaagcactctcctactccctgtccatattagatgcatctcctgttttcaagggagagaaacccctgctcagcccctgatgagcacatcatcaaatatttactattgttttattaatcaatgtgggtggttattatgtgtctctggctcagggagtgtttcatccaactaagctccctcagtggttgtctcacttcatctcttatagattaacttccttccaaaatgtcaccattcctgtacctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaagacctcaagccaaacaccactatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttg

SEQ ID NO: 2258 - DNA, 475 bp, Homo sapiens
  Genbank Accession No. M14199
atcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttcta

SEQ ID NO: 2259 - DNA, 1549 bp, Homo sapiens
  Genbank Accession No. M14218
agaactcggagccagcccggcccgggggaccctgctggccaaggaggtcgtcagtccggtcttgtcttccagacccggagaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctggcgttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccagcccacgaggctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatcgccaggtgcgggcgctactgcaggcacagcaggcctaggtcctcccacacctgccccctaataaagtgggcgcgagaggag

SEQ ID NO: 2260 - DNA, 3344 bp, Homo sapiens
  Genbank Accession No. M14338
gaattccgaagacgcaaaagcagaaacccctgataaaaccatcagacttcatgagacttattcaccaccatgagaacagtatgggggaaaccaccccagtgattcaattttctcccaccagttgcctcccacaacatgtggcaattatgggagttcaattaaagatgagatttggatggggacacagagccaaaccatatcaagtacaaagaaaagagtctcataagatgcaagtgaggaagagttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcctaggagattttgaatgtgaatgccccgaaggctacagatataatctcaaatcaaagtcttgtgaagatatagatgaatgctctgagaacatgtgtgctcagctttgtgtcaattaccctggaggtcacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatctatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaattctgttgtgatataaatcacagtaaagaaattcttacttctcttgctattaagaatagtgaaaaataacaattttaaatttgaatttttttcctacaaatgacagtttcaatttttgtttgtaaaactaaatttttaattttatcatcatgaactagtgtctaaatacctatgtttttttcagaaagcaaggaagtaaactcaaacaaaagtgcgtgtaattaaatactattaatcataggcagatactattttgttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaaaaaaggaattc

SEQ ID NO: 2261 - DNA, 490 bp, Homo sapiens
  Genbank Accession No. M14483
tccttgcccgccgcagtcgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaacggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaact

SEQ ID NO: 2262 - DNA, 2828 bp, Homo sapiens
  Genbank Accession No. M14636
gttgaaagctcctggcgcggcggggcggactccacccctgcccggcagcccagcgcctccggccgcacttccagctctctgcgcagcccgccgcgcagcccgccgccccagccatgggcgaaccgctgacagaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgggaccacctggtggggcgctggatccgcacgcagcagcactactacgacaagtgccccaagagggaatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgagcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtcaaggaactgtgtttgatgccttcccggatcaggtggccatccagctgaatgatactcaccctcgcatcgcgatccctgagctgatgaggatttttgtggatattgaaaaactgccctggtccaaggcatgggagctcaaccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccctctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgagcatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctacaatgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagga

SEQ ID NO: 2263 - DNA, 808 bp, Homo sapiens
  Genbank Accession No. M14777
agttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaggagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacct

SEQ ID NO: 2264 - DNA, 3350 bp, Homo sapiens
  Genbank Accession No. M14949
agctacccaaagagaaggggacagagacccagagagagagagtaatagagactcagagagacagaggggacagagacccagagaaaagggggcagagacccagcaacaaggacagacatctggagagagagagaaggacagggcagggcgcagtggctcacatctgtaatcccagcactttgggagacccaggcgggcggatcacctgaggtcaggagttcgagaccagcctgaccaacacagcctgaccaacacatctctactaaaaatacaaaattagccaggtgtggtggcgcatgcctgtaatcccagctacttgggaggctgaggcaggagaatctcttgaacccaggaggcagaggttgcagtgagccgagatctcgccattgcactccagcctgtgcaacaagagcgaaactccgtctcaaaaaaaaaaaaaaaaaaaaaaagattcagagagacagacgggacagagacccagagaaaagggggcagagacccagcaacagggacagacatttagagagagagggacagagactgagagaggcatcccaagggcagggcttcgtcctgtctgccggggcactgcagtaactatcctctccccaccccgccagtcctacttcgtgtctgactacgaccccactattgaggactcctacacgaagatctgcagtgtggatggcatcccagcccggctggacagtgagggcggcaaggatggatgatggatgggggtggtgtcagtgggggctgagtgctcttgggggtgactgcggggagcctggtccccacaatggcccctctccctgtctctgcagtcctggacaccgcgggccaggaagagttcggggccatgagagagcagtacatgcgtgctggccacggcttcctgctggtgttcgccattaatgaccggcagaggtgacaggggttactggtggcggagcagtgggtgggtgtggggaggacctgggctctgcagctggctggacctcatgcctccggcttcactcgcagtttcaacgaggtgggcaagctcttcacgcagattctgcgggtcaaggaccgcgacgacttccccgttgtgttggtcgggaacaaggcagatctggagtcacagcgccaggttcgggacacccctctttctggggaccccatctcagtctgggaggctccttccagcacacctgtcccccatcagcatcctcctctgttcctgcagtgctgcgactgccactgtcacacagctcacctagatgggttacccccaaactggaccttcagggtccccggcatcaccgagcagagggcctagcatgcaagtgtcctcaggagaggctgctggacggaacaaaggacattcaccccccgtccgccagctctctttgccccttcctcgcattcctcccttccagccaacctcccaccagccccagcacctcccctgctcatggccggccccctccatggctccccagttcctccccaggtgccagatgccccgcacagttgcgcccctcctttccctgctcccatcacttcccccacaacgatttccacacagaactcatccatctggcaaaggctctggggatttccaggctttggggttccgcctgcctctgccgggaacaccctgacttccctgcctgcccactcctggttatctaaggcatagcagggcaagtgcccacgaagcctgcccccatcccttacttagaagacaccaagcccctgcggcatctccctccataatctctcaggagctcttcctctttgagttctcacagtgggtcacctctcctagagtatccagcctgcctgtctgtctctctggctgcggtcaccctgagtgcagggacctgactcccccgtgtcccccctacccccaggtcccccgatcagaagcctctgccttcggcgcctcccaccacgtggcctactttgaggcctcggccaaactgcgtctcaacgtggacgaggcttttgagcagctggtgcgggctgtccggtgagccaagtccccttcctgtcgtccttgtccccagcccttccactccaaactcactggcgttttcccacaggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaggaggtgctttctaaaaaggtaatgagggtcgggcactgtggctcactcctgtaatcgcagcattttgggaggccaatgcgggaggaccgcttgagtccaggagtttttgaccagcctgggcagcatagcgagacccccatctcttaaaaaaaaagggtgggggaatgaactctgggaaggtgaacgaattcatgccacatagcgagaccccatctctacaacaaaatgaaaaattagccaagtgtgcactcgtagtcccagctacttgggaggctgaggcaggaggattgcttgagcccaggaggttgaggctacagagttgtgatcacgcgactgcactccagcctgggcaacacagtgacaccctgtctcaaataaataaataaaatgtaaaaaacgaagtgttcctaggacacagatgggctttgggtatccagactgaagtgtgtcatccatttacccactgtggccttaagacacccaacacttctgcttctcccaggacagaatagggggttggatgggggatgtccacactgaccccaaattggattaagtgtttagattcagatttcagtgctactgggaactttctgaaaatgaggacttgccagacggctgcttggacaccattccacccacctgtcccttctcgatatacattgaaggtgagagtgggacaggcagggtttgtagcagttgctccctgtctctatttttgtagacagagtctagctcttgcccaggctggtctcaaactcctggcctcaagtgatccacccatttcggtctcccaaagtactgggcttacaagcgtgagctaccacacccagcagctgagttgctgcctgtctccaatgtcctagaacgttctattggaatgttctaga

SEQ ID NO: 2265 - DNA, 13500 bp, Homo sapiens
  Genbank Accession No. M15205
  unsure (1)..(13500): n = a or c or g or t
aagcttccttcttggaattccaaactaataaatgagctaactccgccccagccccttagtccctccctgcaatccacctacctctgcagacatcttcttccaaggaaccttgcttgggaaacccacaccagacacatccatcatggcgtctacagccgcatgggcgtgcgtccctctgtttatatggccagagccccgcctcgctccgcccctttaaacttggtgggcggaccgaggcggggctcagaccaggccccaccccgatcagccacgtccatcgccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaccaggggcttactgcgggacggccttggagagtactcgggttcgtgaacttcccggaggcgcaatgagctgcattaacctgcccactgtgctgcccggctcccccagcaagacccgggggcagatccaggtgcgggggccagccctgcgcgtggctggggatgaggtggtcgtggtgatagcctgtgtccaggcatccgcgcagggcgggccctcaaatgacctcaccttctctcctaggtgattctcgggccgatgttctcaggaaaaaggtaatggcttcgcggggctggggtggagctccttcctcttctccggggaccccttgtccctcccctcccctcccctcccctcccctcccctcccctccccttccctccccttcccttccctccccttcccttcccctagaaggaccagcacagcctcctacagctcccgcccggggtgctcctcccttgaattcagtccaggaggaagtctctgccctcttctgcccaggccaagcccctcgtcctgtgtggacgccactccctcctggagctggtgacagctgcttacagcttagctgtcttccccaccaagtcctctgagaaggtggcaaccagttgtgtcccctgtaggccaggcctttttgtacacccctattcaatgtggctgtttccttctaaggccaaggaaacgtagtcgctttctaaaccaaggagtctgaagccgtggagcctctgctctcctgaggtgatagaaccattccctgacccgggtggggctagtgagtttcttgagtaaactacccacgcaccattctttttgttttgtttttgttcttctagaggtaggatcttgctatgttgcccaggctggtctcaaactcctgggctcaagcaattctctcacctcagcctcccaagtagctgggactacaggcgtgcaccccccccgcctccacccagctaattttattttatttttatagagctggggtcttgctatgttgcccaagctggtcttgaactcctggtctcaagcaatcctcctacttcagcatcccaaagtgctgggattacagatgttagccaccatgccctgccccaacattcttttatggccctggggatcacttcagctcaaaccccttgctcaggaagatgtggctcagagttggacttcttggacccagaagcaagtgcttttgacgctgcacacaaagactttctgaaattaatttagaaaagctgtatgccaggtgtggtggcccacgcctttaatcccagcgctttggaaggctgaggtgcgttgatcacttgaggttaggagtttgagaccaccctggtcaacgtggtgaaaccccatctctactgaaaaaaaaaaccaaaaattatctgggcatggtggcagcctcctgtaatcccagctactcgggaggttgaggcaggagaatctcttgaacccggaaggcaggggttgcagtgagctgagatcgctccactgcactctaacctaggcaacagagcgagactccaccccaaaaagaaagaaagaaaaactctgaactctgggaacaactctgggatgaggttactttggaatgcagtcgcaggttccctctacatgtagcctttgcttctgccttccccactacatcttggagaaggttactcctcccacacttcctgggaccacctgagtaccattcctggacctcttccccatagagaattctgacttccaaccctctttgtagggatattataccctgcctgctctgccctgctcttttctggctgtggtgggctcagtctgcataccactagggacaatgaggagccaggcttgttggggaggggtctccttctcccactcctcccgccgtggacctcacctgaccctctctcctcttgcagcacagagttgatgagacgcgtccgtcgcttccagattgctcagtacaagtgcctggtgatcaagtatgccaaagacactcgctacagcagcagcttctgcacacatgaccggtcagtccctgccccctgcagtcctgtccagtggaaaatcacaaggcacaggacacactgttaggactctctttaatggggatggttaatcatttgaacattgaatgattcaaatcagcacactttccaaggtgcttggcaaggtagcgcacactctccactccctgggctggagccagtggttctccactgagggtgattttgccgccagggtccatttgacaatgtttgaagacatttctagttgttgcaactggaggggggaggggatgcttttgggctttaatgtgtagaaatcagggacactgctgctaagggtcctatggtgcagaggacggcccccatgcaagaacgagctggccccaaatgtcaggagcctgccagtgttcagaaactctgccgtagggtttcagcttcacacaggctgcagactggtttggtttggcctgcacgttgatttttgtttaattttttagttgtccgttgttggctggctcccccgtcacctggcagccttcacgcttccctgttttatgtgtagctgtttgagctcgctggacatttccgcctgcaacctcagtttgggagttaaattcacttccttggcagcagatgtgggcccgatgtttctgagcctgagacgctttgcttggtcctctggacttgtccacctgggcacccagtggcaaagccatgctgtgccacacattatagggcttcagcctcagagccctggctgggagctgtatccgagagttgctatggctgtgcagagaacagatccacccggcgtgtggccttcggtgggagctgaggggctcctgaagccagatgctggtggagtggagggtgcttggggcttggagttgcatgtgggaatttaaccgcaccttcgtgaccatgctgtctgatgtaggtcatttacttttccaaatttgcttcctcattcctaagatgcgatgtccacggcacagggtggtgttacacctggtggggacagggaaagcagaggaggtcacttcgttccagctgttggaagtacaacttctggagtcagtcagatccgggattaaatatgagttctgcccgtgtgtcacaagtcatctctaacacgggccacagaggccaaggctgggccagcagcattgatggctcgagaggctgcccttgcaggggccacagctggcctcccacctgccctcactttgtctttctctgtttagggagggaagagggaatttaaaatgcccaaaatactgtttcacacattctttccagaactcgaagtaggattatagcaaggtaataacgaaacaatagttgtaaagtatgtttttttgtttgtttgttgtttgtttttgggacagggtctctctctgtcacccaggctggagtgcagtggctcaatcatagcttactgttacgtgaccccaaacccttgggctcaagtgatcgtcccacctcagccccctgagcaggtgggactacaggcgcacaccaccacacccagttaatttttacatttttttcacacagtgtctcgctgtgttacccaggctggtctcgaactcctgagttcaagtgatcctcccgtcttggcctccccaaagattacgggcatgagctgctgtgtctggccagaatacaggattttaaaaatttatgttttgcaacataattaatataaagacaaatataacccaggcccagttctagttattcattcttctgaattttaaaaggaaacatttggctggcccctaatggtatcatgggccctggtacctgatgaagttggcctagtctgcccccagctcctgaacagtggaagagtttttagtctcattgagctttgtactggacattactaatttctaatccaaagcatcaagtgaagtggcttgtataaataactggttttcctctgggaggctaaggcgggtggatcacttaaaagttaggagtctgagaccagcctggccaacatggtgaaaccccatgtctgctaaaaatacaaaaattagctgggtgtgatggtgtgtggccagtagtcccagctactcttgtggctgaggtgggagaatcgcttgagacccttgagaattgggaggtagagattgcagggagccgagatggcgccactgcactccagcctgggtgacagagcaagactctgtttcataaaaaataaataaataactggttttctggacgagggcctttcccataggtgctaacttctcaaagcccggctgggtgaacactgagcctgctttgcaggtagcaggtggtcacgacagtgccattccctggcccctgcattgtggcttctggcctccctggccctgctcacgctctggctttctcttcccaggaacaccatggaggcgctgcccgcctgcctgctccgagacgtggcccaggaggccctgggcgtggctgtcataggcatcgacgaggggcagtttgtaagttggcttgtcttggcatcactcttcctgccttccgctgtgtcctcccgttttccctcgctgacttggaagttatctganncttttagtaaaataacaaggttaaatagctacaactagtgttggaataccctctgaaggcccctttctagtttccctgtcatagtgtcatagtcttgtaggattcgttttactttttttttttttttttttgagacggagttttgctcttgttgcccaggccggagtacgatggcacaatctcaccgcaaactttgcttcctgggttcaagcaattctctcctgtctcagcctcccgagtagctgggattacaggcatgcgccaccacgcccagctaattttatatttttagtagagatggggtttctccatgttggtcaagctggtctcaaactcccaacctcaggtgatccgccccgccttgaactcccaaagcgctgggattacaggcatgagctaccacacctggccattgtacctttttaaaaatacatatatctatttactggcaagatgcagtgactcacacctgtaatctcagcctgtgggaggccaaggtggacagatcacttgagcccaggagttggagactcacctgggcaacatagtaaaaccccatctctaccaaaaaaaaaaagaaattagccagtcatagcagcgcacacctgtggtccctgctactcaggaggctgaggcagaaggatggagcctgggaggtcgaggctgcagtgagtggtgatagcaccactgcactccagcccgggcgacaaggccagaccctgtctcaaaaaaaaaagggggaggtggggagtaatgtttggtttgcctcatggttccttttgcttgtttcttatacgtttattttcttgttgttgaagtaccttttttagtagtttttgcagccaggaggtatagatgggaagctgccagtctttgtatggaaatctttcttttgtcatctagtttaagctgggcagcaagaggtaggttgatcttgtgtgggtttgggtttttttttttttttgagacggagtcttactctgtcgcccaggctggagtgcaatggtgtgatctcggctcactgcaacctctgccacccggattcaagcgattttcccacctcgcctcccaagtaggtgggattacaggcacccaccatcatgcctggctaatttttgtagagacaagggttcaccatgttggctaggctggtcttgaactcctgacctcaggtgatccacccgccttggcttcccaaagtgttggaattacaggcatgagccgccgtgcccggccttttttatttttattttttttgagatggagtcttgctctgttgccctggctggagtggagtgacgtgatcttagctcacagcaacctccgccttttgggttcaagcagttctgcctcatccttccgggtagctgggatcacaggtgcgtgccacatgcgtamtcatttatgtatttttaatagagatggggtttcaccatgttggccagctggtctggaactcctgacctcaggtgatccgcatgcctcagctcccaaagtgctgggattacaggcgtgaaccacgcctggtcttgatcttgttgctttgaaaagtagcagcgctggtcattgtgtttttgctcagaggaaggccgccatctctctaatgttacctctggtcaggtattctatctgttctctctcagcacaatgtgtgtaggggaagctttgtttcatttatcctgctttatagctggtgtgccttttcatttctggggaaggaatgaagccattatcacttcaggtatttctctcctcatccatctctgaggtgttctgggttccatcttccagagtgtgttttgtttcagtgactatttttacatctgctgctctaattcatcatgctccgttttgtttgacaagttactgttgggttatttttaaatttatgctgttccttccattatgttcctgaaaatcttttcttagacttttccagatttttctatttcctcaggaacatattctgtggttgagtttctgggttattttctgttatcttagttttctttcctctgctttggagattttatttttgttagtttatcacaaagaatgaaactgaaactctctccaaggggtttagcagacttgacctcttaggtacttttagggttgcctcgaagtacacaatgtggtggtttgatataaacataacaggaatttatttctcgctcacagaccccctacgtggttccaggccggttgatggggaggccgcccacgaggcggcttaggtcgccctggctggctgtatacagacacggaggggaagagacgtggcggagcccctgggtgtgaggttttcatgggcctgaccagaagctgcaaacgtcacttctgctgatctttcaaagactagaacctgggcacagggccacctatacgtttagtatacttagtccagttcgttttttgtttgtttttaaaaacagtcttgctctgtggcccaggctggagtgcagtggcgcagtctcggctcactataacctccatgtcccaggttcaagtgattctcccgcctcagcctcctgagtagctgggattacaggcttctgccaccatgcccagctaaccttttgtatttttagtagagacggggtttcatcatgttgaccgggctggtctggaactcctaacctcaggtgatctgcctgcctcagcctcccaaagtgctgggattacagcgtgagccaccacgcctggccacacttagtctagttctataccctggaggaagaataaatgagtttgtttggtgagtgcttcaaggtctctacccgccctgcctcccagcacagagccaggccgctctggcctgaataccctgcccggacgtcacagggcctgtcccctcaaaaggccagtcctgccttcctggttctgttcttgcccaacattctgtatgagtcacagctgcaaattccattcccgtggggaggctgacgggtcccttcccctgtgcggggcatctgccctgtggagttgaggctgccagtgtccgctctgggttcccgaccacccggcagctggcatctcctccccgcttgggtatggccattccgtttctgaccttcagaggtgcgcccctgagcacccccatgcctctgcgtacgtggagacgtcgttgttgctgccccgtgcttgagggactcctggcgagaaagtgagcccaggctgggaatagggctgcagctgttctcttttgctcccaaactgtggcctcagaatgcatccagggattttgcatcagctttggggacatggccctctcagaacaaggaagcttcagctttggcaaggctctccctccttcagacctgccgctgtgagttgttcaatagctctgttctcctggctctgcgtaaaccttgttgacagaggctgacccagacccccgaggcagaaacctttcccttctccttcctcgacatccaaatgccctgagtcaggagccagcgtatgaagtcctgtcccctgttcagcctgtaggagggatttctcggtctacttcctccctggccagcaagtaaaacttgagttcattcagtgagtatttattacaccctacccagacatcagcattctgccctggcctctgtgtgcccttgttctcttcaagaagttccgggtcaccagcctgaccaacatggagaaactccgtctctactaaaaatacaaaaattagccgggcgtggtggcgcactgcctgtaatcccagctacttgggaggctgaggcaggagaatcgcttgaacccggtaggcgaaggttgcagtgagccaagatcgccccattgcactccaagcctgggcaacaacaagagcaaaactcagtctcaaaacaaaacaaaacaaaagaagttcagggtcttcccattgcaagcagttctagatcgaggagaggggttcctagcatgggacccagcagaaggactgtccttcgctccttcattgtctacgtggacagtggatgaagctcagccgaacctgccttgttcccgttttctgggtcagcagggaaagcctttcacagagtagccaccgtgccatcctgaggaaggccctgggtcagaagcttctgtgcttctttgtaccccgggcaagacacacaggtgctcacactgctctgtagaaactgttggcatccaagagagactcacctggaaatctctggaaaacctgaagctcctagctgggggtgctgtgcttcagatgctggtggtgggtgggcacccttgcatcaacagctgcacagtgtgtggtgggcttgcagggtcgcttggcaatagtaggagctctgatttatttttttaaactttttttctggctgggcaggtggctcacacctgtaatcccagcactttggaaggcctaggcgggcggatcacttgaggtcaggagtttgagaccagccaggccaacatggtgaaaccccatctctactaaaaatacaaaaattagccaagcgtggtggcacacacctgtaattccagctacttgggaggcagaggcacaagaattgcttgaacctgggaggcagaggttgcagtgagccaagattatgccactgcactccagcctggatgacagagcgagactctgtctcaaaaaaaatagacaaagccaggcgcagtggctcatgcctgtaatcccaacactttgggaggccgaggtgggtgaatcacgaggtcaggagatcgagaccatcctggctaacacggtgaaaccccgtctctactgaaaatacaaaaaaattagccaggcgtggtggtgggcacctgtagtctcagctactcgggaggctgaggcaggagagtggcgtgaacccaggaggcggagcttgcagtgagctgagatcacgccactgcactccagcctgggcgacagagcgagactccgtctcaaaaaaaaaaaaaaaatagacctttttgtgttttctgttctactacacaagtaatacaggttgagtattccttaacctaaatgcctgggaccagaagtgtttcggatttcaggttttcgaatatttgcatgttcataatataatgagaccttgggaatgagccccaagtgtaaacacaaaatccatttatgttttatagacatcttaggcacatagcctgagagtaattttatgtatttagtaatttgggcgtgagccacagtttttgactgtgacctgtcccatgaggtcaggtgtggaattttccacttgtggtgggcgctcaaaaagtttcagattttggagcctttcaggttagagacatgcaatctataataagtttaatctaggaaaagttagggtctggcacagaggctcacgtctgtgatcccagcactttgggaggctgaggcaggcagatcactggaagtgctggacgggtggggaagtgccgggtgcaagaaccaagctctttgactatggacctcagcctgaggttggtcaagaggtggagtgagtgggggctgaggaccttcatcctgaaaccctgatgcaggagagtctggggtctgccttctaccctcatgtggcgggtgaaggagcaaggttctcaactcaggagggttcttcccctctccattcccacccaggggacatctcacaacaactagaaacaattttgtcgcagctggggggtgggaggtgtgttcctggcatctatctaatgggtgggggcgagggacgcagcccaacaccctacagtgcacaggacacagcgagatccggcctcaaactggcagccatggcagcgtcagccctccagggggcgcgccctggcgcaggtggtgtgccggcccacagctccttgcaggctgggagctgcattttcgtgacatgtcatgagtcctcagagaaaaagagggaacgagtgcatggtggggaggggccctggcgtgctggagtctctgggtttccttctccagagacccctgcagtcagctgagcgcaatcagtcacgttgggctttgcttggatctcactggaatttttcgagccaccccttagtcctcaccttgctaagccctcacgtctcaataacctcaaacctcagtacctgggctgagaaagcctgagtggccctgggagagagaccctgcacccaaggacaaggacatccctgcttcacccaacccaaaggccagtctggacatatgaactcaaccagctaagagtgatatgattgattgatgagaatcaccagagcacttgccagagtttcagcttctccctgggccaaagtgaagtttgctttacacagtaaatgtgctctgtgcaggtcctgaatttagaaggctgtgctgtgtcatcctgctctgtaaatggccagtaggacccccgccccttctcaaggcacattacccgtttaaaacgggggaggcaagagcacaaagcgcccacctattcaccgaagagcatgtatataacttagggccttccatccttaaacaacaggaccttccttgctcttacggaaaaggaaacaggttcagagacgttaattcattgccaaggtcacacagataatgggtccagcgaagagtggtgtccgagcccaaggcagcaggcctttggccactgcagtgttaaacagcacagctggtgtggaagtccggtgctgagtcctgggtacctggactcggagggaagctggctgcagggggaaggggctgcgcagttgtggatgtacctgtcgtctgctggggggcgtgcgggtggacacagtcccccggcctggggagcctcgtgggagaattaagagttactccgggccaaatggccggagttgtcagatctggcagcgtcttcgctggggctccagggagctgctgctggggtggaagctctcacactctttctccacgtgccctttccagttccctgacatcatggagttctgcgaggccatggccaacgccgggaagaccgtaattgtggctgcactggatgggaccttccagaggaaggtaaggcgtctgatccaggtctggagctgggattgaggagggcaagaggcttctggatgggcacagagacaccagctctgggtgaccagggctcagccaccacagggttacggccgagctgctcaggcttggctgagccaagggactccatggtctgtgcagactgcgtgccatctgttgtggcaggtgctttgaattggcaaagggacagagccgggcatggtgctctgggggttgggggaaggactaaggtcagagcaaactctcctggcttcagtacttgtgaatcagagggtttaaaagaaaaacccacctggtaaggtgctgagcgccctctgtctttccatgggagcacagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcaagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtggacgcacatttctctttcacctgggtttccctgggtctcatggacagctccaacttgatttggg

SEQ ID NO: 2266 - DNA, 2431 bp, Homo sapiens
  Genbank Accession No. M15465
tgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagaccatagccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcagcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatcggattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgagggtgctaagcatatcctgagacgcccctcccccctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattctctgcatccaatctgctcagcaggccctaagatgccttgagtctttaatcccaggtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaactcgtgctgggcttgtagaccactgtcctggctgctctcatgcctgcctgataccctgcttggtcaaatcccggctgcttccttctgcacccagaaattccttcccactcatgttgttcccacacacaaaccaagagccaaaaatgagtgtgtc

SEQ ID NO: 2267 - DNA, 1062 bp, Homo sapiens
  Genbank Accession No. M15517
aagcttaaatgagctctagtgcatgcatatatatttcaaaattccaccatgatcttccacactctgtattgtaaatagagccctgtaatgcttttacttcgtatttcattgcttgttatacataaaaatatacttttcttcttcatgttagaaaatgcaaagaataggagggtgggggaatctctgggcttggagacaggagacttgccttcctactatggttccatcagaatgtagactgggacaatacaataattcaagtctggtttgctcatctgtaaattgggaagaatgtttccagctccagaatgctaaatctctaagtctgtggttggcagccactattgcagcagctcttcaatgactcaatgcagttttgcattctccctaccttttttttctaaaaccaataaaatagatacagcctttaggctttctgggatttcccttagtcaagctagggtcatcctgactttcggcgtgaatttgcaaaacaagacctgactctgtactcctgctctaaggactgtgcatggttccaaaggcttagcttgccagcatatttgagctttttccttctgttcaaactgttccaaaatataaaagaataaaattaattaagttggcactggacttccggtggtcagtcatgtgtgtcatctgtcacgtttttcgggctctggtggaaatggatctgtctgtcttctctcataggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattc

SEQ ID NO: 2268 - DNA, 4656 bp, Homo sapiens
  Genbank Accession No. M15656
ggccagtttagttgtgctcagtggctatggattgcaacacattggtctaatgaggcctggagattggttcagaagcttttgccaagcaacaaataagaattccttcatcctgcctccctgcagtgtaaatgtgccaaggtcaagtggctctatgactagctttgagtttcacctggtgggacctcttgtccttcaggtcctcgctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggtaaggccttctttcttctctaactcaaggtcttagccctcattctttggagagccacaagctttctgtttgtccagaaatctgcttctattcatgaaacaaacctctgttatctcacaggcagccagcacttcttctcccacttcagaataccaagcatcccaagtctgcccaaatgcccacaatccatgtatttcttcaacatttcactgccttccttacgtatttaaagcacttatctctagcccaactagcttcagcaaaagcaaactgatttctcagtttgctttaaggcaaattaagcagagaaaagactgagacattacttttctggtaggttcattgcttgctttctcaagcagggtatataaggtgggactaatagagtgaaatggccttctctcctaccaggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggtaagatgctgccacctcttatctacttgatgatgttcacatttggggcttgactttccaacacggagaagcattgttttcttcgggccaagaaggtatctaccaatagtgtctattaggcatttgaaaatgtggcagtagaggtcagtatgaggattgaggctagagagaattttgaattatccacactagagtatagttgatgacaggagactgaaggacaatttcaacagaaacacttcagagggaaggagataagaggaccaagaactgaacctaggatactttttattttgggaagatgaagaagagaagcaaccaagaaaagcagcgattatattgtagggtgaaccaagcattctgggaataaagacagaagaatttctttctttcatgtttatttgtttgtttgtttgtttgttttgagatggagtgttactctgtcacccaggctggagtacagtggcacaatctcggctcactgcaacctccacctcctggattcaagcaattcttctgcctcagcctcccaagtagctgggactagaggcatgcgccaccatacctggctaatttctgtatattttagtaaagatggggtttcaccatgttggccaggctggtctcaaactcctgacctcaggtgatctgcccacctcaacctcccaaagtgctgagattacagacatgagccaccacaccagccgggtaaacaatttcaaagggccaataataacatgctatagagagattcaaaagaaaggccaagaaaagaccctgagattggcatttaggagcataccagtgaccctcactgaaacagtttcaataaagaggaaaggaaaggtgcccactcaagaagtttttcagaaaaagacccagaaaggttgccaggagaaatgaggaccaacaaagtttttattcaaataataaccaaaatttttaaaatacgctttatgagccaagaactggggtgaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaaagcagttaaaggaacttgctaggaaattgatcggacgttatggccagacatagccaagcatcaggtaatgtgcagctgaaataagagtgagtgtgtggtagcttcattcctgagttttcctaacagcagtctaaagcatgcaggaagattcagaacgcaaaatagcggggtagaagagtgaaagtttaataggaagatagaagagtgacaaattttaccgatagcctctgttagcttgctgaccatagaggaagctaggcaaggaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaagaatggtgcttcccaagctccagtgtggatctgaatcacctgaaggtgattttggttttgttgttatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttaaaatatgtaataaatcattgttaactatagtcatcttactgttgtatcaaacactagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatataggtagaaaatggaaatgtttttaaaataaacatgtttttcttttggtatagtgtactatactagtgagaaatttttcaactttagtttctagtactgttgctgcaatattgttggtactgaacagagatttccccagtaactgacacaaacctcaagcttaccaaagaaatgctcagaaaactgggataaaaaggggagatactttatagaaggggatggtatccccagcaatattcagcaacattgctgtaaaaagaagaaaatctgagtgaaggtttgactggtttcccatgagaggcagacagggtcaaggtggggtcacatttactctaaccagtctcctctctcatatttgtcttctaggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctctaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcc

SEQ ID NO: 2269 - DNA, 1360 bp, Homo sapiens
  Genbank Accession No. M16364
ccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcggcgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctccggggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctcgtgcttcctaacttattgcctgggcagtgcccacatgcacccctgatgttgcccgtctggcgagcccttagccttgctgtagaaggactgtccgtcacccttggtagagtttatttttttgatggctaagatactgctgatgctgaaataaactagggttttggcctgcaaaaaaaa

SEQ ID NO: 2270 - DNA, 1550 bp, Homo sapiens
  Genbank Accession No. M16447
gtggcctaccatggtttcaacgggtaacggggaataagggttcgattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctacgatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctagggacaagtgtaatacatttatgtgaagtaagacaatgcgagactggtggccgtcaaatagcatccgtcaatctgtgttaactgcataggaggctctcgatagcacctgctatagcggtgtcatgttggatcgctttgtgactgttcatctgtccttgacagtggctgtcatcttgactactttgttgatttgttggtattggggacattttaaaggctgagttatttttgaatgtcatgtttatgtcatagacgtagaaaacgcatccttgaattaaactgccttaactccttttgtggtataagcaaactacatggactctgtccctggtatccttttcctgtgtggttgcccctgtgcctgtggtctggcctaggttaagtgtgcaagataactactcgtgagttattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacac

SEQ ID NO: 2271 - DNA, 2381 bp, Homo sapiens
  Genbank Accession No. M16474
atttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaagttaaatattgaaacactgtacaccatagtttacaataattagtgtttcctaagttaaaataagaattgaatgtcaataatgagaataattaaaataagcacagaaaatcacaaaaaaaaac

SEQ ID NO: 2272 - DNA, 929 bp, Homo sapiens
  Genbank Accession No. M16594
ggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttactcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgt

SEQ ID NO: 2273 - DNA, 2297 bp, Homo sapiens
  Genbank Accession No. M16750
  unsure (1)..(2297): n = a or c or g or t
gcgccgcatcctggaggttgggatgctcttgtccaaaatcaactcgcttgcccacctgcgcgcccgcgcctgcaacgacctgcacgccaccaagctggcgccgggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccaggagggaagcttctgtctccagctttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctannnnnnnnnnngctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaaaac

SEQ ID NO: 2274 - DNA, 1538 bp, Homo sapiens
  Genbank Accession No. M16961
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 2275 - DNA, 6909 bp, Homo sapiens
  Genbank Accession No. M16967
gaattccgcagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcagaagtcaagaacatgctaagcgtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctgggaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttccccagccctcggtcagatgcccctttctccagacctcagccatacaaccctttctctagacttcagccagacaaacctctctccagaactcagccatatgactctctctccagaactcagtcagacaaacctttccccagcccttggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattacacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaa

SEQ ID NO: 2276 - DNA, 1995 bp, Homo sapiens
  Genbank Accession No. M16973
ctgtggcatctcctgtcacattgggaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggctt

SEQ ID NO: 2277 - DNA, 2397 bp, Homo sapiens
  Genbank Accession No. M16974
ttttttttttcatcctactttgttttattgggcgttgattgttacaggtcccagcctgtagacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagagagtaagacgggcagctacacccgcagcagttacctgccagctgagcaactggtcagagtggacagattgctttccgtgccaggacaaaaagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 2278 - DNA, 26928 bp, Homo sapiens
  Genbank Accession No. M17262
gcgtgagccactgcgccctgaccacatataatttttattaattataatgttgaaagtccctttattccacacctctcctctcattcactcctggtaggtcatttttaatgatttgatgtatatactgaatttggatgcttcttgctacagggcaaagacgctaataagattttgctggagccttttcacagatgcaagtcaatccaggcagtgtctatagctgctgaacccaaaatcagaaagcgagggctatcaaagctcttctgtcctgatttgcaactttagtagtgcaagaaaaaaaatcttagaataaaaaatgggtaccgttcagagacctttagagattgcaaggcatcacagatgataaaaagctccatctctagacgtgttcaggagtgggttggggctttgaccttgactagctgcatcaacttggacaagtcacttcgcttccctgtgcctcagtttcctcatccataaaatggggataagtatagtacctacctcataagtcctgcctacctagcacatggtgagcaattactaaattgtaggcctagtccctataatcccagcacttttggagaacaaggtaggggaatcgcttgaagccaggagttccagaccagcctggccaacatagtgagactgtgtttctataaaataaaaaaaaaaaatacccaagcttggtggtgcaggcctgtagtcccggctacttgggagtctgagtcaggaggattgcttgagcccaggagttcaaggttgtagtaagctatgattgcaccactgcactccagcctggcgacagagcatgaccctgtctctaaaaatataaaattaggccaggcacagtggttcatgcctgtaattccaacattttgggaggccaaggcaggtggatcactgtgagctcagcagttcgagaccagcctgggcaacaaggcaaaatcctgtctctactaaaattacaaaaattagccaggagaggtggtacacgcctgtaatcccagttactggggaagctgaagcaggagaattgcttgaacccgggaggcgaaggttgcagtgagccaagatcgtgccattgcactgcagcctaggagacagagcgagactcgatctcaataaataaataaattaattaattaataaaaaaataagttgggcatggtggcacctgcctgtagtccaagctactcaggaggctagaggtgggaggatcacttgagccaggagttctaggctgcagtgagctattatcacgccaccatactccagcctgctgtatgtactccagcctgggcaacagagtgacaccctgtctcaaagtaaagtaaaataaaaattaaaaaacaaattactaaattgtacttaacagtattgtcatcagtcttcctaaataggaggacaggcaaaattaagggacttaacatgtgccctcaggtatagtagtttggggcaggccagcatcacccgcacagtagttctgtactgtaggtgcgtgttctctgggtcaactttatggcccagtgaggccgtactctaccagaatgtcaggggacaagggttgggagaggcaaaagtgctggtctgaagcaggagtctgggtttccatcctagctctaccaccaattctgtatgaccgtgccccctccatttcctccatgaccacatagagacatggggcagttggatgaaatcaatgattcccagtcttggctctatcatggaaccatttgctaacttctttttttctcttatggatcccatatttttaaagatttttactaaatagaaattgacttatacttttccaagctggagtgtggtggcatgatttcagctcactgcaacctccgcctcccgggttcaagtgattctcctgcctcagcctcctgagtagctgggattataggtgctcaccaggcccggctaatttttttgtatttttagtagagacagaatttcaccatgttggccaggctgatttcaaactcctgacctcaagtgatctgctcacctcagcctcccaaagtgctgggattacaggcgtgagtcactatgcccagccgcttactcacattttctagtcaaaatagaaaactgcttaagtcactgtctgcagaagagcaaaaaaaaaaaaagaaataaaaaattgaaaactgctgatcagattgagaaaaacataagattattcaccacctaaagagaaaaaatttcagtcgaaagggaaaaaaattcatttttgtcttaataaggcaaattcacaatttttgaggttttaacaaaatatatgcagaaagacaaggccaccccgtagaacgtgcacacagccctaggcttggaaatggctggatttaataatatctggtctttctttgagccctgaaattctctaacactatgtcttggaacataattttactgttttcagtggttatagagatttgctttacaatttagcattggtctttacccatgattttgtttgacgccaacttgttggcaggaatgcaccccctgccccccgctttgttatggccttgctcctatagggcaagaatatctgctttaaggccgggtgtggtggctcaggcctgtaatcccagcactttgaggggccaaggcgggcagatcacctgaggtcaggagtttgagaccagcctggccagtatggtgaaatcctgtctctactaaaaataacaaaaattagctgggtgtggtggcacacacctgtaatcccagctatttgggaggccgaaacaagagaaccacttgaacccaggaggcggaggttgcggtgagccgagattatgccactgcactccagcctgggaaacagagcaagattccgtctcacacacaaaaaatatatatatgtctgctttaagtatgcaggccgtgtttgtgctgaacggcaggaatgccaaacttggctgcatggtaccaactagggacctcagagttccaaggagaacaaacagttggttcctggaggctgggggcttgtatcagaccctgaagactaagcatgtgctgggtccattgttgtcctgcacccatggtagtgcactaaacacctaacctatatttaagtgtttttgtttgtccaaaaaatgtcttttttttttgggagtcaagagtcttgctctgttgcccaggctggagtgcagtgacacgatctcagctcactgcagcctccgcctcccgggttcaagctattctcctgtctcagcctcccaaatagctgagactataggcacgcacatccatgcccagctaatttttttatttttagtagagacgaggtgtctccatggtggccaggttggtcttgaactcctgtcctcaagtgatccacctgcctcggcctcccaaagtggtgggattgcaggcatgagacaccgcgcccggcctgccttgtcccttcttaaaatgagttgtccatttgtaagctgctgatttctttgggacattgtctccgtaaacttttcataaagcatcagtgatttcaccattcttccacccaagcttcaccgtaaatttgttgtttgttcttgcttcaatttcagcagaattcatttagctctgataagggctcgcttcaaactgatgtcttatccttcttagtgcctcaaactacatcctgttcactcatgttatagcaagttagtgtgagtttattttggtgcacaaaaatttttttaaatccatgcagtcttttttcataatacgcattttccatgaacttttcgaagaccccttgtagatgtctgttgtttaaaccacccagtttacagtaatttttttttttttttgagatgaagtcttgctctgtcgcccaggctggagtgcattggcacactctcggctcactgcaacctctgcctcctgggttcaagcaatttttctgtctcagtctcccgagtagctgggattacaggtgtgtgccaccatgcctagctaatttatgtgtttttagtagagacggggtttcactatgttggctaggctggtctcgaactcctcaccttgtgatcggcccgcctcggcctcccaaagtattgggattacaggcgtgagactcttgcacttggcctacagtaattttatagcagcctaggctaagatagccatttctgggtataagaatgtcatatactgaacaggcctgcaactgtgagtaaaagtctgcaaagaggccgggcagtggctcatacctgtaatcccagcactttggggggccgaggcaggtggatcacctgaggtcagcagttcgagaccagcctgaccaacatggtgaaaccccatctctactaaaaatacaaaattagctgggcgtggtagtgcatgcttgtaatccctagcatgcacttgggagctacttgggaggctgaggcaggagaatcacttgtactcaggaggccgaggttgcagtgagctgagatcacgccactgcactcctttctgggtgacagagtgagactccatctcaaaaaaacaaaacaaaacaaaacaaaaacaaacaaaaaaacccaacaggtaggtagcagtggttcacgcctgtaatccccactttggaggctaaagtgggcagatcacctgaggtcaggagttcacgtccagcctgggcaacatggtgaaactctgtctctacaaaaatacaaaaattagccaggcatgatggcgggtgctgtagttccagctattcgggaggctgaggcaggagaatcgcttgaacctaggaggtagaggttgcagtgagccgagttcacgctattgcactccagcctccatctcaaaacaaacaacaaaacccaaaatatatattataattttattttatttattcaattttattttattttattttatttttctaggaacaggtctcattcaggccaggcatggtgctcacgcctgtaatcccagcacttgggaggccgaggtggaggtgggcggatcacctgaggtcaggagttcgagccatcctggtcaatgtggcgaaaccccatctctactaaaaatacaaaaattagccaggtgtggtggcacacgcctgtaattccagctacttgggatactgagtcaggagaatcacttgaacagggagatggaaattgcagtgagccgagattgttccactgcactccagcctgggtgacagggcgagactccgtctcaaaaaaaaaaaaaaaaaagaaagaaagaaagaaagaaagaaacaggatcttactctgttacccaggctggagtacagtggtgcaatcatagctcactgcaggcatgcaccaccattcccagctaatttttaattttttttggtagagatgagggtcttgctatgttgcccaggctggtctcaaactcctggcctcaagcgatcctgccatgtcggcctcccaaagtgttgggattacaagtgtgagccactatgcctggcctaaaaatatatatatgaaaatatataagaaatgggcctcccaggaattaaggtgtttgcgggagtcctggtccccagtttttctgccaacactccctgttcccacacatgacctggtccagaccccaaacagccaggcccaaaggacaggtgaggcgaggcgagaacttgtgcctccccgtgttcctgctctttgtccctctgtcctacttagactaatatttgccttgggtactgcaaacaggaaatgggggagggacaggagtagggcggagggtagggtaggaccagaagcctctctaggcctgccatggggcaggcagccagggagaaggagggcccctcagtggagacccagggatttcagtagcccctgttccgggacaggcgcaggtcctgggaggtgacagaagatagactaaaggcccaagagtccctggacctgactcctcccagcagctgccacacacaaacacacctccaggcaccctggacaggaaggaggagaaatgggcccctcctccagtggctgagaagctggggcaaatgttggctgttcctatccctggtgcatcccatggcgaggggcaacttccatcaggccacaccttttatctttgtctctatttttgatatctgtgtattatgattatacaaacccccacattggcctatatgtgcagatctgattaagaacttacgatattccatggacattccattcctaatctcctttagtcctcacaacaaagtattattcccattgtatagatgaggaaactgaggcacacagagatgacaagcaaccaccgctatatgttaggattcgaaggagctccaggaaagtctcatagccccactggccagaatgggctaaatctcagagggggagggtgggagatgggggtgacagtgaccttttttgtgactcctcctagaccatccatccctgctcccaggaggacctgtcctcccagatggtggagatggacaggaggactatctacccacccgtccccacggccctgaccctctgacctcaccctctccgctgatttcttcatgttagttcaacattacccagaggggtcaggacagacaattcctcagtgacccaggagctgacacactatggcgcacgtccgaggcttgcagctgcctggctgcctggccctggctgccctgtgtagccttgtgcacagccagcatggtaagggagtgcttgcaggctggaacaggctggaggactggggtgtgggcccatgggctggggtctcctggctggacagagcacacagagctggcccctaagtaggtctcagccccaggcggccagcttagggaagaagtcaggagctcagggctggaaagagaatggctgcttctctcttccaatatagggagcaggctgggggcaaggggcagtgtaggaggggcacagggggccacatttagcagccttccaggccttccaccagcccagactgcctctctcagaagccagcaggggagggtgggcttgcttcatgcccccagatggccaagactgcctgttcctgaggtcgctgttccatgacccccccaccgcctttacagtgttcctggctcctcagcaagcacggtcgctgctccagcgggtccggcgagccaacaccttcttggaggaggtgcgcaagggcaacctagagcgagagtgcgtggaggagacgtgcagctacgaggaggccttcgaggctctggagtcctccacggctacggtgagcctgggctgctcggacggtgccggggcctcagaccgggcccaactctagacacttccacagagaagcaagcgaggaacgccacagccccttcgctgctcacagcctcatttcaactctgagcccctcctcacagggctggcaagaggagcggcctcagcctttcctgggggtctctgtgcctggactgtgtccctgtgcagctccatgacatggggaggcctccacagtcttcagacatccacctgccttggagctctgtgtccacatggcctcctcagcggcagactcccacaccacccttgaggggtgggactctggggaggccaccacaagcccccgggctcaagactcagtgttcctggagctctgtgtcgcctttcctgtctgtagggactctgccagggacccactgccccctctcctcccatctcccccagcctctttcagactcggtgtgtgtgttggaggaactcccctatcctcaaatattcttctccttttggaaacaaaagtaggaaactctgccacaaacctccccagagcctgccccctgcgtgaccagggtaaggaaagtgtgaggaggagcataacatttactaaaacaacacaaaacaggagctgccgtagcctcactcccagcccttgtttttcaggatgtgttctgggccaagtacacaggtgagcaccgggaaggatttgccccaggaagggaggcctggggaccccagtgagagaattctacccagagaatcttctgctgcacctagccatccacccatccaccccttccccactccttccttggtccctcccatctgttcatccatctttctgtttctcaccaacatcccatccaccctgactccagctcatcctggccataccccaatcccaaaggtaaacacctgggtcttttccagcttgtgagacagcgaggacgcctcgagataagcttgctgcatgtctggaaggtgagcaactgacacgggtttggggagcaggacatggaggggagcttgggagaagagctcaggggtgggtttggagtgtggctggtggaggccgaggcagtccccagcatctgacattgctcccattcctggggtcaagatgtctctttgtacctggctctgtgtctggcatgcgaacgaatgaatgaatgaatggactaatgaattaatgtttttttttttgagacagagtctcgctctgttgcccaggctggagtgcagtggcacgatcttggctcactgtaaactccgcctcccggattcaagcaattctctgcctcaacctcccaagtagctgggattacaggtgctcgccaccacgcctagctaatttttgtatttttagtagagacggggtttcaccatgttggccaggctggtcttgaactcctgacctcgtgatccacccacctcggcctcaaagtgctgggattatagaagtgagccaccgcgcctggccatgaattcatgtttaaggcttcattctcctttgcctgacccgagtctctgcccccacctagtcagagctttgatgatgtcacattccccttctagctttaggtgtcactgaaccaaacaggaacccaaacccccagctgctctgacaccaaggacttccctaagcatgccaaggtgtttctagcacctggccttgcatatgttgtcaatttcctctggagcgaccatcacatctactgaacactttcctatccttcaaggactgcttcaaatgtcaccacttttgctgagacttcagggagcaccctccctcctgcactgtgtctgaaggcacctttagcacgacaaaaatggaactctttgtttatttataagagcagggtctcccttttttgccaggctgatcttgaactcttgggctcaggcaattctcccatctcagtctcccaaaggagtggattataagtgtgagccaccatgcctggctgccatactttcatttttttttttttttttttgaggtggagtctcactctgtcgcctaggctggagtgcagtggcgcgatctcggctcgctgcaacctccgcctggcggttcaagtgattctcctgccttagcctcctgagtagctgggattacaggcacacactaccatgcccagctaattttttgtattttttagtagagacggggtttcaccatgttggccaggctggtcacaaactcctgacctcaggtgatccaccagcctcagcctcccagagtgctgggattacaggtgtaatccactgcgcccagcctcatttgttaaattacgtactcaacagacattttacaaagttcctgctacgtgccaggcactatatcaggtgctggggattttaagagaatcaaatacagtctctgccttcaaggaattcaaaatctcaaaagagaacaaaaatacaaaatattaaaatgattgcggccgggtgtggtggctcaagcctgtaatcctagcactttgggagctgaggtgggcgcccaggccaggggtttgagaccatcttggccaacatagtgaaacccccaacctctactaaaaatacaaaaattagctggggtgtggtggcacgcgcctgtaatcctagctactagggaggctgatggggagaatttcttgaatctgggaagcgaaggttgcagtgagctgagatcatgccactgcaccttcagtctcggcatcagatcaagactcatctcaaatacataataaataataattcaataagtgattgcaagaaagttctgttcaaggcaccaagagaccacaggaaaatgagtgtctggtttgccagaaaatgagagatggcttcccaggagaggcagagttctgcctggcctagtgggatgcatggatgaacaaacaagtgggcattccagtcagaagaaacaatccgtggaaagacccagaggcatgagaagctgagctagcagggacaggtagaccagggccagttgaaaaggaccttcatcactttttcatcctgctggccaagagaagccacagaatggaagctccatgagggcagggctgtgactgtcctattggttgatgtgtactgagcacccgacagtgcctgtcatatggtaggcacttagcgaatatttggaggccactgttgagtgaatgggagaactgctggttgcagaggaagaggggctgggtgaatgcaggttcaggattgtggacctgcatgagctgggaggtgggggatagacaactttgcagggagagaggaaataagtccccaggctccaaggctgaccggggtggggtctccgcaggtaactgtgctgagggtctgggtacgaactaccgagggcatgtgaacatcacccggtcaggcattgagtgccagctatggaggagtcgctacccacataagcctgagtgagtgaggggtcggccttcccaccatgggctgagaacagggagcaagcgtacctcaagttcaacagcctcctgttgggcaatttcctcttccagaatcaactccactacccatcctggggccgacctacaggagaatttctgccgcaaccccgacagcagcaccacgggaccctggtgctacactacagaccccaccgtgaggaggcaggaatgcagcatccctgtctgtggtaggctgggggcagtggggcgacccatgaccaagcccgggggcttcatggggcctggcagcctgggatgggaaccaagaatactggctacccaggcacagtggctcatgcccgtaatcccagcactttgggaggctgaggcaggcagatcacctgaggtcaggggtttgagaccagctgggccaacatggcaaaaccccgtctctactaaaaatacaaaaattgccaggcgtggtggtgggcgcctgtaatcccaactactctggaggctgaggcacgagaatcgcttgaacccgggaggcggagtttgcagtgagctgagatcctgccactgtacttcagcctaggcgacaagagcaaaactctgtctcaaagaaaaaaaaaagatgctggccaccttcagagctggcgtcagtcattcagatcatatctgtgcctattgctcagtaaagtcagggaatcaggggatctgagtggggggatctgccagcctcctcctccccctccccactcttgacttccttatggtctaggctgtggctcattccaaacatgcctcctttctgatcaaggcactcctccctccgggaagccctccctagccatttcagtccacacaccctgttctgagtatcacagagcaagccttgtgcagtttggcccgcgggattctgtcattattatttccttggtgtgttaagtagctatagccaccccttccctgaggcagaccacaataagcatttctttttcccatgagggttggcaggtgtggctgcactcgctaatgcgtctgtagggtcaactgacggaggttggccctggctgggtggctctgattcaaataatgggtccagctgagtctggctcctcgttgagggttgggcctagatctgctccacgtgcgttcatgctggggctgaggctgaaagaaggtacctgggaaaactcttcttatgctgatgacagacacagaaaacaatgaacagaaaagcgtcttctgtcctgaaggcctggctcagaacaggcacagtcagccctgcccacgttccattggccagagcaagtatatgttcaaggccagggtcaagaggtaaactacacctcagcctgtaaaatcacagagcaagggatgtggatgcaggcaggggtaaagaatttgtgccgattaccagtccacaaacatgcgttagtgtttgttctctaggcaaccctgtcgggcccattgctcattcctggggttggtcttttttttttttctttctaagaaggagtctcactcccttgcccaggctgttggagtgcagtggccctatctcagctcactgcaacctccgcctcctgggttcaagcgattcccctgcttcagcctcctgagtagctaggattacaggcgtgtgccaccactcctggctaatttttttttatgttagtagagacggggtttcaccatgttggccaggctgatctcaaactcctgaccttgtgatcctcccgcctcggcctcccaaactgctgagattacaggggtgaggcactgcgcccagccatttttttttttttttttttttgagatggagtctcactctcacccaggctggagtgcagtggcataatcttggctcactgcaacctccacctcctgggttcaggcgattctctgcctcagcctctcatatagctgggattacaggcacacgccaccacgccttgctaattttgtatttttagtagagacggggtttcttcatgttggccttgcctgacttgaactccttgttccggtgatctgcccagctcggcctcccaaagttctgggattacaggtgtaagccactgcgcctggcccctggtattggtcttatagcaagtttatcccaacaaaaacagctactatttactccccaacccccatacacacgcacacacattgatgataaataagttgcaggcttgcagaaattggcccatccaggtgaacagcctagtgatccgagcaagcgtcctgctgtgcagctataaaaacatgactcctccagcagctccaggcagccactaccagttggttacagatggcctaggaggccaaacctggttactatctctggtttattatgtgccagacacttatgctgtatattttgtttaatcctctcaacaaacctgcaaaagtggcattagtaacccctttaaaggcaaacggtcagaagcccagagaggttaagtaacctgaggtcacacaggcagaaagcagcaagaccggggttcacacccctgtctgttccggtccatgtgtggtctcactcactctgctgcctccttgcccctcacccaccaggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtggtgagctgcctgggtagggggcctgagttgcagggacaaatcctagtgggaataacaacagccgcttctgcttatcgaacgcttacctcattgagtgcgctcattacagccttacagtaaccaggtggggggtaaggtcctgtgcccatttcacagataagtacactgaggccccaggaggttattgcctagtagcccaactgtgcatgcacgcttaacctctgcaccaaatggcctccaaggcccgtaggggaactggggggatctaggggatgggtgaggaatggcccagcccagtcccggccggtgcctgggtcccaacagaggaggccgtggaggaggagacaggagatgggctggatgaggactcagacagggccatcgaagggcgtaccgccaccagtgagtaccagactttcttcaatccgaggacctttggctcgggagaggcaggtgaggtagtgggcatccgaggggatgcggggctgcggggctggtggccaggacttgcccctcactgcttggcttgctctgcagactgtgggctgcgacctctgttcgagaagaagtcgctggaggacaaaaccgaaagagagctcctggaatcctacatcgacgggcgcattgtggagggctcggatgcagagatcggcatgtcaccttggtgtgtcctggagccctgcgctaccattcactcctgggggcaggtgtgctgctggacccccaccctcaggccctgcctgcaggcctgggctttacagatgacaacagctgagcatccaggatcccaccaactccacacagcagccacatgagatgggttgtttacttcttttttttttgtttcttagatggagtcttgctctgtcacctaggctggagtgcagtgctgcaatctcggctcactacctcgatctcagctcactgcaacttctgccttccgggttcaaacgattctcttgcctcagcctcctgagtagctgaatttacagacatgcgccaccacacccggctaatttttgtattttaagtagagacagggtttcaccatgttggccaggctggtcttgaactcctgacctcaagtgatccacctgcctcagcctcccaaagtgccgggattacaggcatgagccaccacacccggcccatgggtcctttacttctaagcagatggtaaagctgagactgacggagctggtggctcacctccgcgcacagctaatgggtttgaatccagttcttctgattccagagctgtgctacgctatgtgaactctggactggaaggacctagttagggggtgcaaaaagcaggaggcaggtcaggtgcagtggctcacccctgtaatcccagcactttgggaggccaagacaggaagatcacttgagggcaggagttcgaggccagcttgggcaaaatggtaaaaccccgtctctactaaaaatgcaaaaattagccaggtgtagcagcatgtccctgtagtcccagctactaaggaggctgaggcgggaggatcgcctgagcccaagaggctgaggcttcagtaagctgtgactgtaccattgcactccagcctgggtgacaagagtgagaccctgtctcaaaaataaataaataaataaataaaaagtgtgaggcagcccctcagcatcacacggaggctccagccccaaaggcggccagcccaagcttggatctgggccccggaggcagctctgcccagctgggttcttagacctgggattgttacttctagggctggtgtagaggcagccccctcatcctcagctcctaatgcttcctgctgcccctcccaggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcacaaggtacagaactggtggcccgtgggtgtctggcaggggtctgagtcctccaaagcgatcatgaggggccttggtggctccgggacacataggatgttctgtataccccccagaatataacatcccagcagtctctgctggaaagccatttggtcacgtcctgactgaggcttggagcgcggggagaatccgtctgtctctggtccctccaacactaggatatagcccatgtgggagtctctgaaaatagagtctgtctggactagggcgtgcagcctgtgcccctgtccccgtcctccaggctgtctgactccaaagccctgcacggctttaggcccaggaagaaacacccagggggctgccatggcaggaaccagccctatcccctccctggtggcctgcaggacacactgtctcccagaaccccaagggcaggcagtttcctgctccttgctgggtgaacctgcagcttctccatttctttcttggggtctctgcaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccaggtgggccaccagatgcttgttagctgaggggcagaagccaagttctgggcctggctctgataccaagtagccttgcaagagcccctttcccttttccaggcctcggtttcttggagtgaacccaaaagttcttttcagtactggcgttttattttttatttatatttatttatttactgacggagttccactcttgtctcccaggctggagtgtagttgtgcgatcttggctcactgcaaccccacctcctgggttcaagcgactctcctgcctcagtctcctgagtagctgggattacaggctaatttttgtatttttagtagagactggtgggtttcaccgtgtcggccaggttggtctcgaacccctgacctcaagtgattcacccgcctcggcctcccaaagtgccgagaccacaggcgtgaacgtctgtgcccagccagctctggcgttttagattctggtctctaagaaatggcgttggggccaggcggctcctgtgggggttggctctcactaggcccttcttccttccccaaagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggcaagtctgtgcagggcgggctgagggaacagtggggcccaagctgggagaactgagttgtgcctgggttcaagccatgtgactttgagcaagttgcctaacctcttggtggctcagtttcttcctctgtaaaatggaggtaaaagtctctatcccataaggttatgggagggttaaatgaagtagtatatattaatgtacttggcatagtatcagtcaccagtgagctcagatagcagcaagaggctgcgggtagggaaatgccattcattcagtcactcagcaaatatttattgagcgcctatcacgttccaggcagcgttctagggtatacagcagggacccagacggacaatgtctgtgccctcagagagcttccttcctaggagggcacatccataaacagatctaaaacagcaatccctgaccagtgctgtgaagaaaaatgaagcacagggagagagaacggctgatgaagtgggcttctaaatagggtggccagacaaggtgggcagatcacttgaggtcaggagttcaagaccagcctggccaacatggtgaaaccccgtctctactaaaaatacaaaaattagctggtcatggtgacgcatgcctgtagtcgcagctactcaggaggctgaggcaggagaattgcttgagccagggaggcggaggttgcagtgagctgagatcgggcatcattgcactccagctgggcaacacagcaagactccattgatcgatcgatcaatcaatcaatcaggtggccagagaaggttggagaaggcctccctgagaaggtgatgtctgggcagggactggaagaggggaaggaaggagtgagcaggcatatctaggggaggagcaccgcaggctgggggcatggcaggcactaaggccctgaggtgggagcactcttggcttgtctggggagcagtagggaggcctggggggctgaggaggggcagcagtgggtgaggggagagaggggggcaggcagaggacagccacttcctttagggcctggaaggactttattgagtgagatgggaagttattgaggggcttgaggcaggttaagaaatgatgtgactgactttaaaagtaaaaaataaaaaaatttagtgtaatttcagactcacagaaaagttgtaaaaataatacaaagatttcctgtatactgtcatccagattgtcctccattctgtggatgtgtgggaatttttatatatatatatgcatagtttgagagcaaatcatgaatatggtttctttttacccataaatacttgagtatttccaaaaaaaaaaaaaatacccaaggatgttctcttatgcaaccacaatacaaatattaaaacccggaaatttttttttgacatagcttcgcgtcacccaggcttgagtgcagtggcacaatctcggctcactgcaacctcctgctcccaggttcaagtgattctcctgcctcagcctcctgagtagctggaatcacaggcatgtactaccatgcctagctaatttttgtatttgtagtagagacagggtttcaccatgttggccaggtcggtcttgaactccgacctcaggtgattcacctgcctcggcctcccaaagtgctgggattacaggcgtgaaccactgtactcggccaaaaccaggaaatttttttttttttttgagatggaatcttgctctgttgcccaggctagagtgcagtggcatggtctcggcttacttggaattacaggtgcctgccaccacgcccggctaactttttgtatttttagtatttttagtagtgatggggtttcaccatgttggccaggctggtcttgaactcctgacctcgggtaatccacccacctcggcttcccaaagtgctgggattacaggcgtgagcaccagcacctggcccaaaaccaggaaattaatgatgatacaatattattgtctaatctatagaccttattcaaatttttgttagtcttgctaatgtcttttatagggaaaaaaaaaaaaaaaagcgtgtttctcacccaggattcaatgaaggatctttctttgtcttctatgaccttgacatgtctgatgagtgcagtctggttattttgtacactggccctgaatccgggtttgtctaaggtttcctcacggtcaggttcgggctcagtggtgccatgtccttcttggtgcatcctgttaactggcacatgagaacaatttgtctcatatgtggtgagtctaactctgacctcttgaggaaggcaatgtctgccaagtttcttgctgtaacttctgtttttccctttgtaattaataagaatctggtaaagagacactttgatgtttttttttttttttttttttgtgatggagtctccctctatcacccgggctggagtgtgtggtgcgatctcggctcactgcaacctccatcccccaggttcaagtgattctcctgcctcagcctcccaagtagcagggattacaggcatgtgccaccacacccagctaatttttgtatttttagtagagatggggtttcaccatgttggccaggatggtctcgaactcctgaccttgtgatccgtctgcctcagcctcccaaagtgctgggattacaggtgtgagccaatacgcctggcctactttgatattttgtattctgtttgcatcaaaaccttctcccaactagggtgactaccaaatggcacttatctaattctgtcattccttctacatttgttagttactttattgctttccttcctttcattctatcagtgtggacttaaggatccttactttattctaagggttcaccttttttttctttttttttgagatggagtttcgcccatgttgcccaggctggatggagtgcaatggcgtgatctcggctcactgcaacgtcctcctcccaggttcaagcaattctcctgcctcagcctcctgagtagctgggattacaggcatgtgccaccacgcctggctaattttttgtatttttagtagagacagggtttcaccatgttggccaggctggtctcgaactcctgacctcaggtgatccgcccgcctcagccttccaaggttctgggattataagcgtgagctctaccgtgccaggccatactttgttactactgttattttttctgatgctcagatgatcccaagtttggcctgtggaagtcccttcaagctggcttctgtgacttggggagatgttctgtcattctttgagtactttctttctttctggcacagcaaaatgattcaggttaatcctactttccttactgtagtgttggaaccagccatttctccagggaacccttgtagtcaagagtggaatttagaactgagatctgggtgctggcgtgtgcacattgctagtgggatgtcattacttctaggctctcttagtggacagaaccagaaaaaaattatatgatgcatataccaatatctctatcatctatataaaaaaccatgagttcctactgaaacctccaattccattctaacaccacaggattaattttagcttttccttttccatatttgtaactctctctgttgacagtgagaaacctgaccctcattatctgtaatgcatttgcctatttgaacaatactagaatatagtttcaaaatcctccatccataacactattaaaaccaatcctatggctgggctcagcccactgcaacctctgcctcctggactcaagccagcctcccactttagcctcccgagtagccagggctacaggcacacaccaccatgcccagctaatttttgtattttttgtagagactgggtctcactgtgttgcccagacaggtcttgaactctgagctcaagtgatccatccaactcagcctcccaaagtgctaggattacaggtgtgagtcaccatgcctggcctctcctagtaaatttttagaagtggtgttgttaggtcaaaaggcaaacatgtatgtcattttttagagatttttaaatttctttccataagggttgtaccagtttgcatttccatcacagtgtatgagaatgcctgtttccccacaaccttgccaaaagaatgtcacagtttaaattttaccaatctgagaggtgagaaatagtacctgaaattgtttaacggacatcttcaaattgaaattgaggttgacaacgaatcatagttaggaccttttttttttttttttttgagtgggtctcctcgtcaccaagctgagtgcatggcacgatttgctcactgcaacttccgccttctgggttcaagcgattctcctgcttcagcctcccaagcagctgggactccaggcgcgagtcaccatgcccgctaatttttgtatttttagtagagacagggttttaccagattggccaggctggtctcgaactccttaccttgtgatcctcccgcctcggcctcccaaagtgctgagattacaggcatgagccaccacgcctggcctaaggaccatttttatataattttttttttgagacagagtcttgctttgtcacccaggctggagtgcaatggtgcaatcttggctcactgcagcctccacttccctggttcaagtgattctcctgcctcagcctcccgagtagctggttccacaggtgcgtgcctggctagtatttgtattatataatttttttgtgaattgtctcttcatggttttttgcccattttttggtccctttcttatcaatttttgtgagttcttcgtatttatattaggcctttatttgtgatatacattgcaaatgttttctcctagtttgtcagtttttttaacctcatgtataatttttctggccatgcagtttaaaaaattactaggtagtcaaatttatcaatcattatttataaatctggtttgaacagagataaactttcctggccaagtgtggtgtttacacctgtaatcccagcactctgagaggctgaggtggggatcacctgaggtcagaagttcaagaccagcctggccaacatggtgaaaccctgtctctactaaaaatacaaaaattagctgggcgtggtggctgatgcctgtagtcccagctactcaggagactgaggctggagaattgcttgaacctgggaggcggaggttgcagtgagcagagatcgtgccgctgcactccagcctgggtgacagagcaagactctgtctcaaaaacaaaacgacaaaaaacaacaacagaaaagcctttcctgatagctaggtcattgaggaattcactcatgttttcttctagtacctgatttcatttttctgcacttagattcctgactcatatggagtttatttttgtatctgatgtgaggcatagatctaatttattattttccaaatggctaactagctgtctctaaaccctttattaaaaattattggccaagtgcggtagccacacctgtaatcccagcagtttggaaggctgaggcaggattgcttgaggccaggaattcaaaaccagcccagacaacatagcaagaccctgtctctacaagaaaatattggtcaggtgtggtggctcacgcctataatcccagcactttgggaggctgaggcaggtggatcatgaggtcaggagatagagaccatcctggccaacatggtgaaaccctcgtctctactaaaatacaaaaaattagctgggtgtggtggcgcatgcctgtagtaccagctactcaggaggctgaggcaggggaatcatttgaacccaggaggtggaggttgcagtgagctgagatcacgccattgaactccagcctggcgacagagcaagactccatctcaaaaaaaaaaggaaaaagaaaatattttaaaaattagctgggcatggtggcatgtgccttgtagtctcagctacttgagaggctgagttaggaggattgcttgagcctaggagttcaatactgcagtgagctatgaccgcaccattgcactccagcctgggcaacagagtgagaccctgtttctattaaaaaaaaaaaatcggctgggcgcggtggctcacgcctgtaatcctagcactttgggaggccgaggcgagcggatcacctgaggtcaggagttcaagaccagcctgaccaacatggaaaaaccctgtctctgctaaaaatacaaaattagccagacatggaggcacatgtctgtaatcccagctactcgggaggctgaggcaggagaatcgcttgaacctgggagacggaggttgcagtgagctgagatccctccattgcactccagcctgggcaacaagagtaaaaactccgtttcgccaggtgcggtgactcacacctgtaatcccagcactttgggaggccgaggtgggtgaatcacaaggtcaggagtttgagacaagcctggccgacatggtgaaaccccatctctactaaaatacaaaaaattagcctggcatggtggtgtgcgcctgtaatcccagctacttgggaggctgaggcaggggaatcacttgaacctgggaggaggaggttgcagtgagccgagatggtgccactgcactccagcctggcaacagagcgagactctatctcaaaatcaatcaatcaatcaatcaatctttgaactagtgatttgagatttcacctttatcacattctagattgtatcttattttcatttatttatttgaaatatagacaagtctccctgtgctgcccaggctgatttcaaactcctggctgggctcgagcaagtctcccgccttggcctcccaaactgctgggattacagacgtgagccaccatacctgacccaggttttattttttagttttattttttcctgcatccagctaatttgatttgatttgtagagacggggtcttgctatgttacctaggctggtctcgaactcttgggctcaagtgatcctcctaccttggcctcccaaagtgttgggattaccagcatgagccacggtgcccagccccacgttctagatttctatggatagagtatgcttaaggatgagtatgtttctggatgttcgactcggctttcctggtctgttgtctgtctgtgtacagcgtcacattgttttaatgatagaggctttagcgtacatagctgggaaggctaatgttctcttttagtttttctttccagtggtttcctggcaattcttgcatgtttgtttttccatatgaactttagtgtcaacatgcctaggtctataaaaaagcttggtggtaattttattgggattatgacacttcaacaaattaactgggagaatgaacatatttttgatgttgagtcattttatccaaggataagaaacgttttcctatttgctcaagtctattattgtatctttcttgactgctgcaatgtattctcttataattttttctattggtatcttattttatgtatttgtaatatcttatttttcttgagtaaattagttaatggcttgccggttttctcaaaacaaatatctagggatttgatttatgaaattattaggcctattatttttcttttttttgagatggagtctcactctgtcgcccaggctggagtgcagtggcgtgatctcagctcactgcaacctccacctcctgggttcaagtgattctcctgcctcagcctccccagtagctggggttacaggtgcacgccaccatgcccggctaatttttttatatttttagtagagacggggtttcaccatgttagccaggctggtctcgaactcctgacctcatgatccgactgcctcagcctcccaaagtgctgggattacaggtgtgagccaccgtgcctggccttttttttttttttttgagacagagtcttgctctgtcacccaggctggagtgcagtggtgcgatctcggctcactgaaagctccacctcccgggttcacgccatcctcctgcctcagcctcccgagtagctgggactacaggtgtacactgccacgcccagctaattttttgtatttagtagagacagggtttcaccgcgttcgccaggatggtctcgatctcctgaccttgtgatccgcctgcctcagcctcccaaagtgctggtattacgggcgtgagccactgcgcccggccaggcctattatttttctattgtggttcattaatttctgcttttttctcttaaaaagtttgcttacgtttttgtctggtttactttgctgttctcttgctagcttttttttttttcagatagggtcttgctctgttgcccaggctggagtgcagtggcacagtcatagctcactgcagccttgaactcctgggctcaagcaatcctcttcttgcttcagcctcccacgtagctaggatcagaggtacatgccaccatgttcggctaatttttttttttcgagacagagtcttgttctgtcgctcaggcggtagtgcagtggtgcaatcccggctcactgcaacctccacctccacctcccaggttcaagcaattctacctcagtctcctgagtagctgggattataggcgcacaccaacatgtctggctaatttttgtatttttagtagagacagggtttcaccacgttggctaggctggtcttaaactcctgacttcatgatccgcccgccttggcctcccaaagtgctgagattacaggtgtgagccacagcacctagtgaaagtgtggtttttttgtgtaggttttactgttgttagtgttgttctgtattgtttgtagaggatacgtggggagatttggataaaagcaactatcattattatcctcatcagacttgtaggtctaactttttaattttttaatttttaatttaaatttttttcttggtcttttatcattaattaattttttcgagacagggtctcactctgttgcccaggctggagtgtggtgacatgatcacggctcactgcagccttaacctcccaggtgcaagtgatcctcctctcttagcctcccgagtagctgggactccaggcatgtgccaccatgcccagctaattttttgtagagagagggttttgccatattgcccaggctggtcttgaactgctgagctcaagtgatccacccggcttgggcatgagccacctcccctggtctggtccaactttttaaaagcattattctgcctgttgggtggagaatagactgtaggtgggcaaagaatgaaggaaactagtgggttcaggagctcgagctagaagtggtgagaagggtttggatttggggtctatgctgaaggtagagccgacaagatttgctaggattggatgtgtagggtgaggaagtggggacagcaagaatgactggaggggtaagtggactctcaccagctgtgtctcgtgaaggggcgtggctgggctatgagctatgctcctgagcacagacggctgttctctttcaaggttacaagcctgatgaagggaaacgaggggatgcctgtgaaggtgacagtgggggaccctttgtcatgaaggtaagcttctctaaagcccagggcctggtgaacacatcttctgggggtggggagaaactctagtatctagaaacagttgcctggcagaggaatactgatgtgaccttgaacttgactctattggaaacctcatctttcttcttcagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgagcctcaatgctcccagtgctattcatgggcagctctctgggctcaggaagagccagtaatactactggataaagaagacttaagaatccaccacctggtgcacgctggtagtccgagcactcgggaggctgaggtgggaggat

SEQ ID NO: 2279 - DNA, 4139 bp, Homo sapiens
  Genbank Accession No. M17466
tcagagagtgtgttgtccctgcagttctcactgtcaccggggagccctgccacttccccttccagtaccaccggcagctgtaccacaaatgtacccacaagggccggccaggccctcagccctggtaagactacgcagaggagttggagcaggggcctgggagacatgtaccctgcctgtccttctgtccaaggaactctgcttggagagaggggactgtgatagggcagggtgggccaggcccctgggtagagcagggaagccttgtctctttctacaggtgtgctaccacccccaactttgatcaggaccagcgatggggatactgtttggagcccaagaaagtgaaaggtgctacacacagcctctggggtggcctggggctctctcctcccgcctcattactctcctggtatcaccagaccccacacacctgggattctggacccagccccttctctccctccacaataccctttggaagtccagagggagagttctgggaaggagtggtcccattttgcaggtgggtaaaccaagcttggaaacttggagtagcaaggtcacaaggcaagtaggttcaagaagggccttggccccagctgtgtgactcagctccctgctcttccttccaccatgtccatctctcagaccactgcagcaaacacagcccctgccagaaaggagggacctgtgtgaacatgccaagcggcccccactgtctctgtccacaacacctcactggaaaccactgccagaaaggtgaggagatgtggaggacctgggcggggtgctgggggacaggggcaaccctgggcctacagaataggttgctggatactcggagacttggcatggtcctagactctcctgagaccactatccctctttgtccccagagaagtgctttgagcctcagcttctccggtttttccacaagaatgagatatggtatagaactgagcaagcagctgtggccagatgccagtgcaagggtcctgatgcccactgccagcggctggccagccagggtgagcagatggttgggaacgggccagggaggagcgtcaggaagacaggctggcaggaggccgggtggtgtgccgggaaggagagctctctgggggggtctttaggcccaggggtggctcactgcgttccctccccaagcctgccgcaccaacccgtgcctccatgggggtcgctgcctagaggtggagggccaccgcctgtgccactgcccggtgggctacaccggacccttctgcgacgtgggtgagtgagggtctggggcaagcagaaggccagcccccaggtgggacgggcttgccaggaaggaggagggagagtgcggaaagcagatgagagggaggcaggagagcccagccttggctgcccagggagccccctttctcctcagacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggtgcgccgcgtggggctgggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtggggggggaaggaggagccgagagggcgccgggcgagctagattccggccagccggccgcgggctccccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttgggcacggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccaggtgagctcttagcccggttggcgcccttccccgaggccgtcaggcacaaatctcaggtccacagcgctgagctgcgtgtttccgacccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaggaaagctcttttcttcatgggtccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattcc

SEQ ID NO: 2280 - DNA, 556 bp, Homo sapiens
  Genbank Accession No. M17733
acaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgctgcctttcccatctgtctatctatctggctggcagggaaggaaagaacttgcatgttggtgaaggaagaagtggggtggaagaagtggggtgggacgacagtgaaatctagagtaaaaccaagctggcccaagtgtcctgcaggctgtaatgcagtttaatcagagtgccattttttttt

SEQ ID NO: 2281 - DNA, 1097 bp, Homo sapiens
  Genbank Accession No. M17885
cttctctcgccaggcgtcctcgtggaagtgacatcgtctttaaaccccctcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 2282 - DNA, 512 bp, Homo sapiens
  Genbank Accession No. M17886
cttttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 2283 - DNA, 4029 bp, Homo sapiens
  Genbank Accession No. M18000
gtcgggggcgggacaggacaccctgcccaccggaggggcgcgccaccgccgcccccgctccactccgccagggggcgctgtgtggctcccgagtaggctcagagcgaccgtggccgggcggaagcggctttctggcctaagctttaacaggcttcgcctgtgcttcctgtttcctcttttaccaaggacccgccaacatggtaggtgttttggctcgaggccgccatcctccacaatcgtcccccatctgcagcttcccgcggtcctcagcccacagagaggccctgggccggaaggcgcagagccctgtcaggctggagcgcaacgggccggcggcttccgcattaagcccggcgcccggcactgtttagccgggccctctccggctcagcgcagccggcggtccccaaccacaccggccggggctcggcgccgcactcttcccagaaggttgcgctggctcgtgagtgatcctgtcctctccacccgcagggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcagggtgagtcgggccttcctcggcctccgggcgtccgcgatctgtttgtgtgctctgccgccctccgactcgggaagagacggtgccttggtggtttcgttagcctgagactccctggtgtcccggagaagggctagagctctgcgtgtgcaggatttctgttgtgaacttaggcctgtgtcatgactggccgcggtgaccctgggtcgaaggtagccaccgtcagacctcttgctttgaagctacgttgcttttagttgtcaacttttttctttcttttttttcttttttttttgagacggaatcttgccctggcgcccaggctagagtgcagtggcgccatctcggctcactgcaacctccgtctcccgggttcaacgcgattgtcatgcctcagccttcccagtagctgggattagaggcacgtgctaccacactcggctaatttttgtatttttagtagacaacagggtttcacaatgttgaccaggctggtctcgaacacctgacctcaagcgatccgcccgcctcggcctcccaaattgctgggattacaggcgtgagcacctcgcccggctggatgtcaacttctaatgcttacttcacagttgcagttactgttcgagagatttataggcatatggcctggaagaatagtgccaaagtcaacgtattaattgccaagttatgtgaatttgaaattggaagaaaatgaaggctgtgaagggtcgtgaaactgcggggcggggcggggcgagtggggggtggggcgcttgatcatcatgaaggagagtttgaatagagagtgagaaagccaaggggaaggaatgctcaggccagtggaggttctatgtgtaggaggtcccaggatagtgagtcctcttccttctcactgtggaaaagaactaaagcgggtatttatatatccacatgtgctcagtaccaggtgggagttgatttgtcttctcactgttctctttggctgtgtgtgctttgtagttatgtcacgcatctgatgaagcgaattcagagaggcccagtaagaggtatctccatcaagctgcaggaggaggagagagaaaggagagacaattatgttcctgaggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgtaaacacagacttcaagtgttctgaatactgaatgagggcatgggaaggtaaggccagaagaacaggtcatcggggtctgtaatactgtaagagactgctcaccttgtgagaggaatgctatccttgtgcagctcctcttccccatatttaagaacctggggagaggaggaggagaggtgagtgataatctcattgattggtattttgaccctacctcgtttccttgtaggtctcagccttggatcaggagattattgaagtagatcctgacactaaggaaatgctgaagcttttggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtgcttccaggacacttttctctcttggctgcttctgttcttggtttatagctggcttacgttgccccctttgtgtcagccctggctgaatctgcctgcttttcttctgtgaaggcattcctttggtgtctccatgctaaccactcagaaatgagctttggtccatttccaggtacatacaaggcactacttaggtagttcacgagtatcttcattgcactttgatgttttttctatggcttatcttagtccttttgcatacttgggtgaaagcatgggcttcatgggcggttggtgattttgaacaacttcatttttcctatttttatggtcattaaatgtttaagacactcaaaaaggtagtagcaaaatgaactcacatgtactttcccagctacagccccgctgtgggtcttttcttcctgaaataaccactgcgctgaatgcagcatttttgttgaaactaaaatgggtttctgaggaccaaataggacatggagttccaggtataagttgggcccttggcttcttgccctgcctaccagcctgaacttgtttgagggcagggtctgctcttgcctccctcccttctgcttgatgccttgtgtacttgggcccttcacaaatgttgattagattagtaatagctcttacccagggctggtcctggaaagcaagtggcactgtgtattctcaaagggacagagttttgctttagaggacatttggcaatgtccagacacatttttcgttctcatagccaggggatacctgctaacttctaatgggtagaggccaaggatgttgctaaactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaacgtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaacagccttgcctgtgtcatctttgcagttgtgtgtgggtagaggaaaggcaggagctctcgaggcaacagatcagctggcacttgtctgggattcaggtgctgctgcatctggtttatggggagtgggttcaccagagtttagtaaaggagcaagggcaagcctgaacgtgttgagagtggtctgcag

SEQ ID NO: 2284 - DNA, 13957 bp, Homo sapiens
  Genbank Accession No. M18533
gggattccctcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagctgcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagagagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 2285 - DNA, 2533 bp, Homo sapiens
  Genbank Accession No. M18728
ggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccattcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 2286 - DNA, 1633 bp, Homo sapiens
  Genbank Accession No. M19267
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcctccgccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaagcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcct

SEQ ID NO: 2287 - DNA, 14635 bp, Homo sapiens
  Genbank Accession No. M19828
aagatccacctgccttggcctccaaagtgctgggattacaggtgtgagccacttgcacccggccaagctctcaacattttaaccctctgcgcatgtccagttggattttcctaccatttatcaggctcttactattcatgtatcaagcacagtgctgggtgctttaaagaaattatctcggtcctcacaataaactgcgaggtcactgtgagttttcctgtttcatggataaggaaatggtagctcagaggggttatcatttggtcaaaatcacagagctagtaaatagcagagcaggattcaaacagttttcaaaaaacttctctttctcctaaacctgtttgcaaagtccttaatttgtgctgaatgttggctttagaagttgatgagtttgatctgtggctgtttctctgaaccatccttgtatctggttttgatcaccacatttggaacttctgtttaatcctgcatatctccattgaaaggacaaaatcattggtgccaactgattttctttaccatagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatggtatgtgtctcttcccctgtgtgagcacttccaaagtaatgcaggtgttgagacctgtggttacaggctgaactagtaccattcacaactatttcctacgtattttcagatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgtaagtatgagtctgccagtcaataaatacatggatataagtgctaattacatcctcaactctgagctaggtgcaggaaggtttccaaagactgtataaggcatgcttccttcccccaggaattcttggggagaaaaaaaaactttcacaagtgtgtcgttacccagttacacaaagctgaatgtgatacatatcaaagagatgctactaagtagaacagttctttgcctagtggtatcaaaggaagcttcaggacaccagctaggaggctgactatgttagacattccttttataaatatggacagtgatcagtgactggcaacgaagattcataattttctgttatttatttttaactttcagtgcattgtccagcttaataattaacttgtcaaatcggtatttttgcctaatgttcattgctctttgaggctcatccaagcccattaccttaaaaatctcctgtcattttgtaggcaatgagctcatggcttcagaaggcatctgggagtcttccttatacccagactttgcaagaccacctcaatagcctgaaggagttcaacctccagaacatgggattgccagacttccacatcccagaaaacctcttcttaaaaaggtaaaagaaggaaagcagcaaggcttcttgaaccatgcaaagtaaatgaaagattttacatagcatgatttagacatttttttaaatttttaaaggaaataatttaagcattttaaggagattaataactatagcacaaacactgtggcgatctttgcattagtaaacatgagaacaccaaccctgtcaggaagaatctaagaaagtcattagatctgtacttcaccctaagatattttattcagtacaacctgttataagcaaattctccctctgactgtgaagaattcagaatggctagtggcgttattgactacaggcttgctgttaagctagagagagtcagaacagccattgagcactaaatggaggcagcattctgagaaaatactttaacccaggcttactgacttccatacctatgttctttccacaaatcaagttgtctcaattcagtttagcaaatttgtatcaagtatcccctatgtgcaaaatgctagactaggtacagtgagaagatagaaactgggtaaggtatagccttttctttcaagaagataccatggagacatcaaccatgagaaatattaattatataagcaaattatgacatgctctttgagaaaggtgcaaggtctatgtaactgtaagaatgagacaaattggctatgacttaggtgggatggtaatgataaggagtggcccttagaagagctttgtcaggatttgagtgtttgacaggtggaggtaaaagcaaaggggtccaggcactaggagctagcacaaagaaaagtgcagagtggctttgggaatggggccaagtacaatattgctgtgaaggtcagaggcagagaactttgaatgactgatgtctgactgtggggatgttatctttgttgttcatttcagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggtgagctatgctcaggtaaagggtgcaccgggctagttcatggcaggctctaagaggagagcctcctccagggaggaaaggactttggctttctagcagataatcttccttgctacttggaagtcttttattttattcaacaaatagaaatatttattaaacatatcacgtgtattaaatattctagtaggcagtaacagaaagtagacagataagccagcaattataattcagtgtgagaggtgctatgataaagtgtagtatataagtataaggtagagtggaagcactcaacaagggaacctaaacaaagcctgtgtggtcaggcaaggcttcctggaggaatgccttttgctatcagattttatctttgcattacagatggaggagtctattgcacaattggcccagaaaaatggggctttattattgaaagactttcaacatagagattgctctggaaatgtactgcttaatttaaccaatgtcttttcatttttatgttaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgacgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagaccctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatggtaagaaatatcctgcctcctctcctagatactgtatattttcaatgagagttatgagtaaataattatgtatttagttgtgagtagatgtacaattactcaatgtcacaaaattttaagtaagaaaagagatacatgtataccctacacgtaaaaaccaaactgtagaaaatctagtgtcattcaagacaaacagctttaaagaaaatggatttttctgtaattattttaggactaacaatgtcttttaactatttattttaaaataagtgtgagctgtacattgcatattttaaacacaagtgaaatatctggttaggatagaattctcccagttttcacaatgaaaacatcaacgtcctactgttatgaatctaataaaatacaaaatctctcctatacagttttgggaacacacaaaatcgaagatggtacgttagcctctaagactaaaggaacatttgcacaccgtgacttcagtgcagaatatgaagaagatggcaaatatgaaggacttcagtatggagcttttattgaattgaaaccttataccttttgaaaactcattgtgattttcttcatctccataccctttcgtgatagctcatctgtttttctgctttcagggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcaggtaaataccacctaatgagtgacacgcccccaagagcgagtggagaattggggcagatacatttaattcaggaccaaatattcagagattccccaaactaggtgaaagacaggcggtaagcaacaacttcttctctgaggaaatattctctagaagtattacatgagtccttgattgattttaatgtttagatgcacacatgacatcccatcagcactattatttattaattctgggcaaatccaggaagatgagggttatacctcatcatctaaatcataggcaagctcagccataggcagggtatattttcagagaggactggtttctgtagtatttaaaactttaaaattcttcttccccacaatagaattgctagatgagatacataaattcctctcatgtcatttacaagctctgccagggccaaatcaagggtgacattaccagaggagaagaccaaacatggttctatgactgttactaaaagtttgtcatgggcttggagaatgcgtactgatgttgggattctgggtctctgcagggtgggctccaacttgccttttttgctatttcttctttccctatctgtcatttcctgactcttcttctctctcctcttctttctcttccccccactcctcttccagttttcagtcctaggaaggctttaatttcaagtgtcacaatgtaaatgacaaacagcaagcgtttttgttaaatcctttctggggcatgtgataaagagaaattaacaacagtagacttatttaaccataaaacaaacacatgaactgacatatgaaagataaatccctttcagtatatgaaagattctctgatctttatttttaactgctaatgaagttttagtgtactatattgtgtaattggagtaattgaaaacatgttatttttttttttctctctgtttagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 2288 - DNA, 748 bp, Homo sapiens
  Genbank Accession No. M20218
caagacaacattttaggcaaaatcagcctgagcaagatgtgctgaagatgggaagcgtctgagttgatctgtgcaccttttcttgtctcccctcgttctagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatgtttctgaagattactatataggcagatataccagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaatttgatt

SEQ ID NO: 2289 - DNA, 1105 bp, Homo sapiens
  Genbank Accession No. M20471
gccaccgctgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgt

SEQ ID NO: 2290 - DNA, 1298 bp, Homo sapiens
  Genbank Accession No. M20786
taggaatgaagcggtatctgtgagttcaagctgttccctggccaggatctcagacaccctccaaagcacctccaggagcctgtgacgccaagggcagctctgaccacgcatctctggccctgggcaggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtgggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctggctggtttgatgtcaccgttctggg

SEQ ID NO: 2291 - DNA, 3051 bp, Homo sapiens
  Genbank Accession No. M20867
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttaccataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagcttttttttttttttttaactctaacacccttcagaaatttctaactactttgtaactgcatggcttaacctggtgataaaagcagttattaaaagtctacgttttccaaaaaaaaaaaaaaa

SEQ ID NO: 2292 - DNA, 5375 bp, Homo sapiens
  Genbank Accession No. M20902
gcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttcgttaactcagcgtctgaggaattttgtctgcggctcctcctgctacattctgagtgggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgcccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggaggtagggagggaggagggtgccactgatcccctgaacccctgcctctgcctccagagtgcccctccggcctcgccatgaggctcttcctgtcgctcccggtcctggtggtggttctgtcgatcgtcttggaaggtaaaagtgggatgggagaattggggagtttggagatttggaagagtgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggctgtcctgcttcgacagccttgaaagtgggtaagctgggtggggggctctgggagaggtcagtgctgagtaaggcaattcccagcagcttgagccccaccaggtcactccagtattcctccccattctttttttttttttttttttttctcttgagacggagtctcgctctgtcgccgaggctggagtgcagtggcgcgatctcggctcactgcaagctccgcctccctggttcacgccattctcctgcctcagcaggactacaggcgcccgcctccgcgcccggctaattttttgtattttcagtagagacagggtttcaccgtggtctcgatctcctgactttgtgatccgcctgcctcgacctcccaaagtgctgggattacaggcgtgagccaccgcgtccggccattcctccccattctaaccacatgatccccaaggatctctatccatcccggtatcccaacctaagggggttccaataacaaatttttggccgggcagggtggctcatgcctgtaatcccagcactttgggaggccgaggcgggcagatcacttgaggtcaggagttcaaaccagccaggccaacatggtggaaacttcgtctctagctaaaaatacaaaaaaattaggccaggtgtggaggcacgcgcctgtaggcccagctactcgggaggctgaggcaggagaatcacttgaacccgggaggcggaggttgcagtgagccgagatcataccactgcactccagcctggctgacacagcaagactccgtctcaaaacaaaacaaaacaaaaataggctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaaaaaaaaaaaaaaaacaaattttgaacccctgcccatcttcctggcaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacttagggaggccgaggtgggctgattgcctgaggtcaggagttcgagaccagtctgaccaacatcggtgaaatcttagtctctactaaaaatacaaaaaaattacggcaggcatggtggcgtgcactgtaatcccagctagtcgggaggctgaggcaggggaattgcttgaaccaggaaggtgggagttacagtgagccaacattgtgccagcctgggtgacagaaggagactctgtctcaaaaaaaaaaaaaaaaaaaaaaaaaaacaagatggtcttgcccaggaatggtggctaacacctgtaattccagcattatgggaggctgagatgggaggattgcttgagcccaggagttcgagaccagcctgaccaacatggcgagatcctgtctccatttaaaaaaaaaaaaaaaaagatggttttgtgaggtaatgaaaatgaaggccccaagcttggccagacctgggtccccaggctggagtagcaccccttcctgtgtgatcttgacagaggggcattactgtgagcctcagtttcctctcctataaactggtggttctacagggaagtaaaggagcaggcctacagggtgtctggtacatgtagatgctcagtatatcattaaaccaccttcccctttgcaagttagagagtcatttgttctttaaaaaatattttactgagcatctgctaagtgctggaaaactctttcaatgtggggaataaaacagtgaagaactgccgagcacggtggctcacacctgtaaccccaccactttggaaggccgaggtgggtggatcacttgaggtcaggagtgcgagaaccccgtccctaatagaaatgcaaaaaaaattagctgggcatggtggcccatgcctgtagtcccagctccttgggagggctgaggcggagaggattgcttgagcccaggagatctaggctgcagtgcgccatgtttgtgccactgcattccagcctgggtaacagaatgagaccctgtctcaacaaaaaaagaaaagaaaagagaagaaaagagaaaagaaagacagggagggagggaggaaggaagggagggagggagggaaaatagagccaggcataaacttagaaagatcgtttggaggccaggcacaatggctcacacctgtaatcccagcactttgggaggccaaggcaagcagatcaactgaggtcaggagttcgagaccagcctaacatggagaaaacccctgtctctactaaaaaaaaatacaaaaaaattagccggggcgtggtgcattcctgtagtcctagctactcgggagcctgaggcaggagaatcacttgaacccgggaggcggaggttgcagtgagccgagatcatgccactgcactccagcctgggcgacaaggcgagactccatgccaaaaaagaaaaaaaactcctggcgcggtggctcacgccagtaatcccagcactgtgggaggctgagcaggcggatcacgaggtcaggagttcgagactagcctgctcaacataatgaaaccctctctgtactaaaaatacaaaaattagctgggtgtggtggcaggcacctgtagtcccagctactcgggaggctgaggcaggagaatggcttgaacctgggaggcagaggttgcagtgagccgagacagtgccattgcactccagtccaggtgacagagcgaaactccatctcaaaaaaaaaaggaaggcattggtagcaagagatggcaggccttgaaagccaggccagggtgaagtgtttctttttttttttttttttttttctttttaaatttttttttttgagacggagtctcgctctgtcacccaggctggattgcagtggcctgatctcggctcactgcaagttccgcctcccgggttcatgccattctcctgcctcaccctcccgagtagctgggactacaggcacctgccaccaggccagctaattttttgtattcttagtagaatgtagaatttacttagtagaattttttgtattcttagccagcatggtctcgatctcctgacctgggtgatccacccgcctcggcctcccaaagtgctgggattacaggcgtgagccacggcgcccggccttattttttctttttgagatgtacccagactggagtacagtggtgcgatctcggcttactggaacctccacctcccgggttcaggcaattctcctgcctcagcctcatgagtacttggaactacaggtgtgtgacaccacacatggtattttttgtatttttagtgaagatgacatttcaccatgttgcccaggttggtctcgaactcctgacctcaagtgatcagcctacctcggcctcccaaagtgttgggattacaggcgtgagccaaatgcccagccaagggtaaagtgtttagacttaaagtgctttggtccatctgggaaactgaggcagagaagttggcccacccagcccagcggtcctcctaatcccacagacagtggggatggagattctgcaaggggaagaggtgggagtcaggtagcaggcagaatttggacagcctgggaggtagctgcacacagtgacccccttccttattcctccccacagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaattctctcctgagtgcttctttactctggggaaggggctgcgggagagggtaggggcttccagagagggcagggtctgcagccactgtggaaaaacagtatggggtttcctcaaaacattaaagatagaactctcaaatgatccttcaatcccacttctgggtatttattcaaaagaattgaaatcaggaccttgaagagatacctgccctcccatgttcactgcag

SEQ ID NO: 2293 - DNA, 614 bp, Homo sapiens
  Genbank Accession No. M21259
tagtcttttaacatttgagtttgaaattaattaaactgatcacaacatgcaaagaaaacattgggcagcagagggagttacagccctgagactgcttcagccctgctggtgagaagattgaattgaagctttttcagagcagagcaaagacctccctgcagctttcttggcaccagaatagctgggaagaaggataaaagcccagaggagtataatctctaagaaaacctgctggctgccttttccatttccctgtgtggcctttctgacctggctgccctgtggaagcagagctgtgcctgctgtggcttattctgaatggatcaagacatggaaggttctatttttgacagagcaaatgatgatagtgagaattaaggtacagtgaactcttacaattgagctctgtatttagaaatctctgcttgctttcctgctctactggagcctgtggtgtttgctttttaagttgtacttttccaccatctctagattgtttcttccaaccagaatttacgagaggcgttgctctctgcctcgttaaggttactaaaacatcctgctgggaagctgctcttgttggcagcccttgggttatgtcagcttttctggat

SEQ ID NO: 2294 - DNA, 324 bp, Homo sapiens
  Genbank Accession No. M21642
ctgcaggtaaatgaagaaggcagtgaagcagctgcaagtaccgctgttgtgattgctggccgttcgctaaaccccaacagggtgactttcaaggccaacaggcttttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattataaatggactctgcatttgaaatgaagataaggaaaggggaaacatgctattgggg

SEQ ID NO: 2295 - DNA, 3494 bp, Homo sapiens
  Genbank Accession No. M22324
taatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccaggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaa

SEQ ID NO: 2296 - DNA, 1815 bp, Homo sapiens
  Genbank Accession No. M22960
ggggagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaagctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggcgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttc

SEQ ID NO: 2297 - DNA, 1173 bp, Homo sapiens
  Genbank Accession No. M22976
ctgagttgggaggtttgtttgattttgtttttggtggtaggagatacgtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcgggccctgactgtggcacttctgcttcacctgcccactgggttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggtaattactgaattataattttaaaaagtctcaaagtcagcattttggaagtggtactttcatagatttttaaattccataatgtgccttatcttttcattgcaggatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgcccaaatttttcgagtgtgcctttttattcatctactttattttgatgtttccttaatgtgtaatttacttattataagcatgatcttttaaaaatatatttggcttttaaagtat

SEQ ID NO: 2298 - DNA, 3816 bp, Homo sapiens
  Genbank Accession No. M23161
caacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaacaatgatggatacattgactatgctgaatttgcaaaatcactgcagtagatgttatttggccatctctggttatatacaaatgtgacccgtgataatgtgattgaacactttagtaatgcaaattaactcatttcaactactgctgcagcattttggtaaaaacctgtagcgattcgttacactggggtgagaagagataagagaaatgaaagagaagagaaatgggacatctaatagtccctaagtgctattaaataccttattggacaagggcttcttcagcatctgtattagtctgtattaatgctgctgataaagacgtacccgagactgggaagaaaaagaggtttacttggacttacagttccacatggctgggaggcctcaaatcatgccggaagttgaaaggcacttcttacatggcagcaagagaaaatgaggaagaagcaaaagtggaaacccctgataagccatcagatcttgtgaaacttattcactatcacaagaatagcatgggaaagactggcccatgattcaattacctccccttggtctctcccacaacacgtggaattctgtagatacaatttcaagttgagatttggtggacataccaacatatcatctacctggccccttccaaatttaatttcccaatttttaaaaccaattattccttcctaaaattccccaaagtcttaactcttttcagcattaacgaaaaatccacagtccaaagtctcatctgagacaaggcaagtcccttccacctatgagcctgtaaaatcaaaagcaagctagttacttcctagataccaacagggtacaggtattgattaaagacggctgttccaaatgggagaaattggccaaaataaaggggttacagggcccatgcaagtccgaaatccagcagggctgtcaaatttaaagttccagaataatctcctttgactccaggtctcacatccaggtcatactgatgcaagaagtgggttcccatcctcttgggcagctctgccctggctttgtagggtacagcctccctcctggctgctttcacggctgttgttcagtgcctgcgttttccaggtgcacggtgcaagctgtggatctaccattctggggtctggaggacgctggccctccttctcacagctccactaggaatgcccagtagggactcgtgtgggggctcccacaccacatttcccttctgcactgccctagcagaggttctctcccctgccgctgagagggcctctcccctgcagcaaacttttgcctgggcattgaggcatttccatacatcttctgaaaactaggcggaggtttccaaatcacaattcttgacttctgtgcacctgcagtttaacagcacatagaagctgccaaggcttggggcttccactctgaagccacagtccgagctgtatgttggcccctttcagccatgctgagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgccagttaacctaaatcatctctctcaagttcaaagttccacaaatccctatgaaggggcaaatgtcgcagtctcttgctaaacactaacaacaggtcacctttactccagttcccaacaagttcctcatcttcatctgaggccacctcagcctggactttgttgtccatattgctatcagcatttgggaaagccattcaacaagtctgtaggaagttccaaactttcccacattttcctgttttcttctgagccctccaaactgttccagcctctgcctgttacccagttccaaagtcacttccacattttgggtatttcttcagcaggacccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcaagaaacccctgatacaactgatcagatcttctgataaaatctcagatctcatgagacttattcactgtcacgagaatagcacgggaaagactggcccccatgattcaattacctgggggtgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaccaggctttgcagtggatgcttttcagtaacagtgaagtggagtgaatacccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttctcaacctgggagagacctgaatttgagtgtgttctctaatcaatagtggtttagcttctttctatttcactcgtttctagggttttttatttgcagtttaggaactattaggaatgtcaggacttcatcagcaggggtaaaactacactggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagc

SEQ ID NO: 2299 - DNA, 3924 bp, Homo sapiens
  Genbank Accession No. M23234
cctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 2300 - DNA, 3715 bp, Homo sapiens
  Genbank Accession No. M23263
gaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggtggcggcggcggcggcggcggcggcggcggcggcggcggcggcggcggcggcggcggcggcgaggcggaagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttgtttaatttcctctattgatgtacagtctgtcatggaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacacccgaattc

SEQ ID NO: 2301 - DNA, 1296 bp, Homo sapiens
  Genbank Accession No. M23613
gggcgggattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagt

SEQ ID NO: 2302 - DNA, 1093 bp, Homo sapiens
  Genbank Accession No. M24194
ctgcaaggcggcggcaggagaggttgtggtgctagtttctctaagccatccagtgccatcctcgtcgctgcagcgacaccgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacttccctggcctggtctgctgatggccagactctgtttgctggctacacggacaacctggtgcgagtgtggcaggtgaccattggcacacgctagaagtttatggcagagctttacaaataaaaaaaaaatggcttttc

SEQ ID NO: 2303 - DNA, 3003 bp, Homo sapiens
  Genbank Accession No. M24283
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagcctcatccgcgtgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 2304 - DNA, 4261 bp, Homo sapiens
  Genbank Accession No. M24485
aacaagagatcaatatctagaataaatggagatctgcaaatcaacagaaagtaggcagcaaagccaaagaaaatagcctaaggcacagccactaaaaggaacgtgatcatgtcctttgcagggacatgggtggagctggaagccgttagcctcagcaaactcacacaggaacagaaaaccagcgagaccgcatggtctcacttataagtgggagctgaacaatgagaacacatggtcacatggcggcgatcaacacacactggtgcctgttgagcggggtgctggggagggagagtaccaggaagaatagctaagggatactgggcttaatacctgggtgatgggatgatctgtacagcaaaccatcatggcgcacacacctatgtaacaaacctgcacatcctgcacatgtaccccagaacttcaaataaaagttggacggccaggcgtggtggctcacgcctgtaatcccagcactttgggaagccgaggcgtgcagatcacctaaggtcaggagttcgagaccagcccggccaacatggtgaaaccccgtctctactaaaaatacaaaaatcagccagatgtggcacgcacctataattccacctactcgggaggctgaagcagaattgcttgaacccgagaggcggaggttgcagtgagccgccgagatcgcgccactgcactccagcctgggccacagcgtgagactacgtcataaaataaaataaaataacacaaaataaaataaaataaaataaaataaaataaaataataaaataaaataaaataaaataaaataaaataaaataaagcaatttcctttcctctaagcggcctccacccctctcccctgccctgtgaagcgggtgtgcaagctccgggatcgcagcggtcttagggaatttccccccgcgatgtcccggcgcgccagttcgctgcgcacacttcgctgcggtcctcttcctgctgtctgtttactccctaggccccgctggggacctgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccagtgagtacgcgcggcccgctccccggggatggggctcagagctcccagcatggggccaacccgcagcatcaggcccgggctcccggcagggctcctcgcccacctcgagacccgggacgggggcctaggggacccaggacgtccccagtgccgttagcggctttcagggggcccggagcgcctcggggagggatgggaccccgggggcggggagggggggcaggctgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttacctgttccctccctgcactcctgacccctccccgggttgctgcgaggcggagtcggcccggtccccacatctcgtacttctccctccccgcaggccgctgcgcggccctgcgcatgctgctggcagatcagggccagagctggaaggaggaggtggtgaccgtggagacgtggcaggagggctcactcaaagcctcctgcgtaagtgaccatgcccgggcaaggggagggggtgctgggccttagggggctgtgactaggatcgggggacgcccaagctcagtgcccctccctgagccatgcctcccccaacagctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgtgagcatctgcaccagggttgggcactgggggctgaacaaagaaaggggcttcttgtgccctcaccccccttacccctcaggtggcttgggctgaccccttcttgggtcagggtgcaggggctgggtcagctctgggccaggggcccaggggcctgggacaagacacaacctgcacccttattgcctgggacatcaaccagccaagtaacgggtcatgggggcgagtgcaaggacagagacctccagcaactggtggtttctgatctcctggggtggcgagggcttcctggagtagccagaggtggaggaggatttgtcgccagtttctggatggaggtgctggcacttttagctgaggaaaatatgcagacacagagcacatttggggacctgggaccagttcagcagaggcagcgtgtgtgcgcgtgcgtgtgcgtgtgtgtgcgtgtgtgtgtgtacgcttgcatttgtgtcgggtgggtaaggagatagagatgggcgggcagtaggcccaggtcccgaaggccttgaacccactggtttggagtctcctaagggcaatgggggccattgagaagtctgaacagggctgtgtctgaatgtgaggtctagaaggatcctccagagaagccagctctaaagcttttgcaatcatctggtgagagaacccagcaaggatggacaggcagaatggaatagagatgagttggcagctgaagtggacaggatttggtactagcctggttgtggggagcaagcagaggagaatctgggactctggtgtctggcctggggcagacgggggtgtctcaggggctgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctagcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctactatgagcactgtgtttcctgggacggggcttaggggttctcagcctcgaggtcggtgggagggcagagcagaggactagaaaacagctcctccagcacagtcagtggcttcctggagccctcagcctggctgtgtttactgaacctcacaaactagaagaggaagaaaaaaaaagagagagagaaacaaagagaaata

SEQ ID NO: 2305 - DNA, 468 bp, Homo sapiens
  Genbank Accession No. M25079
  unsure (1)..(468): n = a or c or g or t
atggtncayytnacnccngtggagaagtcygcygtnacngcnctntggggyaaggtnaaygtggatgaagyyggyggygaggccctgggcagnctgctngtggtctacccttggacccagaggttcttngantcnttyggggatctgnnnacnccngangcagttatgggcaaccctaaggtgaaggctcatggcaagaaagtgctcggtgcctttagtgatggcctggctcacctggacaacctcaagggcacctttgccacactgagtgagctgcactgtgacaagctncaygtggatcctgagaacttcaggctnctnggcaacgtgytngtctgygtgctggcccatcactttggcaaagaattcaccccaccagtgcangcngcctatcagaaagtggtngctggtgtngctaatgccctggcccacaagtatcactaagctngcyttyttgytgtccaattt

SEQ ID NO: 2306 - DNA, 2354 bp, Homo sapiens
  Genbank Accession No. M25280
gagtgcagtctacctgcagcacagcacactcctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagcttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacccgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcctatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaacttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgggaattc

SEQ ID NO: 2307 - DNA, 871 bp, Homo sapiens
  Genbank Accession No. M25629
tcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaatttctcatttccagatgatctccagtgtgtggacctcaaaatcctgcctaatgatgagtgcgaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 2308 - DNA, 1452 bp, Homo sapiens
  Genbank Accession No. M25753
ttggtttctgctgggtgtaggtccttggctggtcgggctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatactttacaaactaaaattggcacatgtgcatctgt

SEQ ID NO: 2309 - DNA, 1829 bp, Homo sapiens
  Genbank Accession No. M26393
gggattcgggcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccc

SEQ ID NO: 2310 - DNA, 1409 bp, Homo sapiens
  Genbank Accession No. M26576
cctgtgtcgtgtttttaggaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagcttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagctt

SEQ ID NO: 2311 - DNA, 1147 bp, Homo sapiens
  Genbank Accession No. M26708
ctttgcattgttcctcatccgcctccttgctcgccgcagccgcctccgccgcgcgcctcctccgccgccgcggactccggcagctttatcgccagagtccctgaactctcgctttctttttaatccccttcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgttggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctcctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgacatgttcattataatctcaaaggagaaaaaaaacctgtaaaaaaagcaaaaatgacaacagaaaaacaatcttattccgagcattccagtaactgttttgtgtatgtacttagctgtactataagtagttggtttgtatgagatggttaaaaaggccaaagataaaaggtttctttttttttccttttttgctatgaagttgctgtttattttttttggcctgttttgatgtatgtgtgaaacaatgttgtccaacaataaacagg

SEQ ID NO: 2312 - DNA, 4910 bp, Homo sapiens
  Genbank Accession No. M27492
tagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctcgacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaa

SEQ ID NO: 2313 - DNA, 1062 bp, Homo sapiens
  Genbank Accession No. M27826
agcccaagaaacatctcaccaatttcaaatctgatctattcggcttagcgactgaagattgacgctgcccgatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtgggtattgacggccaagcttcaaaacccctgaaaactcccccactctggtgccaacttggacaacactcttttatgcactcttttttagttatccccacctgcccacttcccttattaggccgaaatattttaaccaaattatctgcttccctgactattcctggagtacagctacatctcattgctgcccttcttcccaatccaaagcctcctttgtgtcctctaacatccccacaatatcagcccttaccacaagacctcccttcagcttaatctctcccactctaggttcccacgccgcccctaatcccacttgaagcagccctgagaaacatcgcccattctctctccataccaccccccaaaaattttcgccgctccaacacttcaacactattttgttttatttgtcttattaatatcagaaggcaggaatgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgattgtaattttttattaccttcccaaatcctataaaacagccccacccctatcttccttcactgactctcttttcggactcagccaccggcacccaggtgaaataaacagctttattgctcac

SEQ ID NO: 2314 - DNA, 1955 bp, Homo sapiens
  Genbank Accession No. M27830
gaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaacgtaccatctgtgggattatgactgaacgcctctaagtcagaatcccgcccaggcgaacgatacggcagcgccgcggagcctcggttggcctcggatagccggtcccccgcctgtccccgccggcgggccgcccccccctccagcgccccgcgcgcgcgggagggcgcgtgccccgccgcgcgccgggaccggggtccggtgcggagtgcccttcgtcctgggaaacggggcgcggccggaaaggcggccgccccctcgcccgtcacgcaccgcacgttcgtggggaacctggcgctaaaccattcgtagacgacctgcttctgggtcggggtttcgtacgtagcagagcagctccctcgctgcgatctattgaaagtcagccctcgacacaagggtttgtccgcgcgcgcggcggcgtgcgtgcggggggcccggcggggcgtgcgcgtccggcgccgtccgtccttccgttcgtcttcctccctcccggcctctccgccgaccgcgggcgtggtgggggggtgggggggggacgcgcgaccccggtcggcgcgccccgcttcttcggttcccgcctcctccccgttcaccgcggggcggctcgtccgctccgggccgggacggggtccggggagcgtggtttgggagccgcggaggcggccgcgccgagccgggcccgtgcgcggtccccgtcccgggggttggccgcgcgggccccggtggggccacccggggtcccggccctcgcgcgtccttcctctcgctcctccgcacgggtcgaccagcagaccgcgggtggtgggcggcgggcggcgaggccgcacgggcgtccccgcacccggccgacctccgctcgtgacctctcctcggtcgggctccggggtcgaccgcctgccccgcgggcgtgagactcagccgctgtctcgccgtgtcccgggtcgaccggcgggcttctccaccgagcggcgtgtaggagtgcccgtcgggacgaaccgcaaccggagcgtccccgtctcggtcggcacctccggggtcgaccagctgccgcccgcgagctccggacttagccggcgcctgcacgtgtcccgggtcgaccagcaggcggccgcgacgtgcggcgcaccgacgagagggcgtgcattcccgttcgcgcgcccggaccctccaccggcctgggcccgacggtggagctgggaccacgcggaactccctctcctacatttttttcagccccaccgcgagtttgcgtccgcgggattttaagagggagtcactgctgccgtcagccagtaatgcttcctccttttttgcttttaggttttgctcttgcctttttttttttttttttctttctttctttctttctttctttctttctttctttctttctttctttctcgctctcgcctctcgctctctccctcgctcgttttctttctctttctctttctctctctctctctctctctctctctctgtctctcgctctcgccctctctctctctctcttctctctgtctctctctgtctctctctctctctctctctctctctctctctctctctctctctctctctccctccccctccctccctctctccccttccttggtgccttctcggctcttgacacttagccgctgtctcgccgtgtcccgggtcgaccggcgggccttctccaccgagcggcgtgtaagagtgcccgtcgggacgagccggacccgccgcgtccccgtctcggtcggcactccggggtcgaccagctg

SEQ ID NO: 2315 - DNA, 471 bp, Homo sapiens
  Genbank Accession No. M29194
cacttcaataagctccacctaaaacttaatgctgtgtttgcttcctgttttctattcagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaaggggggtatgtttcactctcataaactgagcttttaaaaaacgatatgatataactattttccactatcagtacaaccaaaaatgtcccaattttatctctggttaaatgttaatatatgcaaataagtacaaattgcaagagccattttagatctgttgttctaatttacatgc

SEQ ID NO: 2316 - DNA, 2943 bp, Homo sapiens
  Genbank Accession No. M29277
gggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagctcaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatgctgtaaatacgctcgtcctgccagcagctgagctgggtagcctctctgagctggtttcctgccccaaaggctggcattccaccatccaggtgcaccactgaagtgaggacacaccggagccaggcgcctgctcatgttgaagtgcgctgttcacacccgctccggagagcaccccagcagcatccagaagcagctgcagtgcaagcttgcatgcctgcgtgttgctgcaccaccctcctgtctgcctcttcaaagtctcctgtgacattttttctttggtcagaggccaggaactgtgtcattccttaaagatacgtgccggggccaggtgtggctcacgcctgtaatcccagcactttgggaggccgaggcggcggatcacaaagtcagacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgagccggccggttgcgcgggccctcggaccctcagagaggcgagggttcgagggcacgagttcgaggccaacctggtccacatgggttg

SEQ ID NO: 2317 - DNA, 2974 bp, Homo sapiens
  Genbank Accession No. M29540
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattgctgattctttaaatgtcttgtttcccagatttcaggaaactttttttcttttaagctatccactcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaaaaa

SEQ ID NO: 2318 - DNA, 2907 bp, Homo sapiens
  Genbank Accession No. M29873
ggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttcttcaccaccatcctccagaacttctccgtggccagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 2319 - DNA, 3045 bp, Homo sapiens
  Genbank Accession No. M29874
cagaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagaggctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttcctaagtgctgatattacaggcataatatgtgatcttttgtgtctggttgctttcatgttgaatgctatttttgaggttcgtgcctgttgtagaccacagtcacacactgctgtagtcttcccgagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctcccc

SEQ ID NO: 2320 - DNA, 835 bp, Homo sapiens
  Genbank Accession No. M29971
gaattcggcacgaggcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtccctcgtgccgaattc

SEQ ID NO: 2321 - DNA, 1787 bp, Homo sapiens
  Genbank Accession No. M30185
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccatccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatcc

SEQ ID NO: 2322 - DNA, 2811 bp, Homo sapiens
  Genbank Accession No. M30257
cgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattaaa

SEQ ID NO: 2323 - DNA, 4898 bp, Homo sapiens
  Genbank Accession No. M30269
gaattccggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgcacttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagctggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgctggcactgatgtccctcctttttcacggagacctatctgaggtacaggatggggctggcaccagatgatgtcccaccacagtccctcacctccggcctccacatgacagaaccaatttacactcaaccatgacctcacccctccttggtttctccctccccg

SEQ ID NO: 2324 - DNA, 802 bp, Homo sapiens
  Genbank Accession No. M30496
ggagggccgggcaccgcggcatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgcccatacactaactcaaaaattttgatattttcc

SEQ ID NO: 2325 - DNA, 135 bp, Homo sapiens
  Genbank Accession No. M31169
aactcttcctcatgtctaggcacagcacaggaatacgggggcatccggcatggtgccaagcttctctacgcatttgctgaggcaactgtacccaaagtcacagtcatcaccaggaaggtgaggacctcatgttgg

SEQ ID NO: 2326 - DNA, 757 bp, Homo sapiens
  Genbank Accession No. M31211
acactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 2327 - DNA, 8058 bp, Homo sapiens
  Genbank Accession No. M31303
tcaaagcaggtgtcttggtgtattgaccaccaaccgaggacacggtcttggtcagagaatgggaggaggcggggaccatgttcatttcatttatttttttcccctttttgtgagagaaagggccagttattctaaggcacggtcagaccaatttcctttgtgcctttgctgaggttctgagctatccaggtcagggagaacagtgaccttgtggctcctttttcgatttttaaaaagaacccactgctgctctggggagcacgtgctctgagaacaaaagcaacacttaactgcaatctgtgtagtctagaacggctattgctcttcctcccctatcatccgcagaaggcttggaagaacagatggagtctgcatttaagctgagtggctttgttagaccaaaggcgatcaaattccagagccccacgctttcccgcacaggtccctggtcaccggctcgggaacctgaggatgctggcaagaacgcacacagtgagggaagggccacgcccgcgacctgtgggctgagtggattagaaattacgatgatgtcacaatatgggtgacacgccggtgtcggtgtagggtgccgggggcagggggccctgcaggggcgtggagtggcattgtgctgtcacaggggctcgggcgtcttaggcacccatgtgggtggcgcactagaaggggcactgctctgtccgagtgctgcccttggggcgaggcgggcatgtggctctacaaggtggagtccaggcggccaaagtttggaaaggtagggaaggacccccccgccctccgcctcgtccgccctgcccttgttctcgagaatggggagctggttcggacctagtccggggtccactgccacgccctcttccacggcgagaccacccccctagtcccaggcccacacctggggatgctccccaggcgccctgcaacccccggcattgtcctcctgccctccgggacaggactacacttcccgaggtgcttcggggtcccggggggcggcgctccacgcgggttgtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggtgggtgcggggctcggaggaggcggcggctggctgaggccagcaagagggacgcggtcggcgggaggggctgggccgtggcagcgaccccctgctgcagggcggcgggcggggctgcgggcctcggaggggttggtgggcgggggtcgctccgctttgtgtggctcgggcggacgtcgcctttgtccccgctctccgggggcgcggctgttcgtgggcagggggctgggcgatcaccgggcggtacgctccggggtgccgtccgcaaggagacaatagggggccgtgggcccatcgtttacctccctccctccctcccttccctgcgggccccgccgggttccccattgtctgaagggtcggggcggtgccagggaccagcggctttaggaccaaactggcgggtcagcccagggccgcgaccctccctgcgaccgtgcccactggcgaccgcagctggtgattgagggagggcggcgctcccgggccccacgagggttcttctgtcttcgcggccggacgcgcggacagcttgggtggcggcaggttgggcatggggacggcgggaggcggtggcgagctcaccgcgggaccacccgggggcctgttcccggggcctgccccacccgctgaactgtgaagggggtggtggcggcggcctggaggtgtttttggcgggagttggggggggcgtccgcgcagggggagtcaggcaggggcggagttacccggattggaccgttagccccgcccacccctccccttcccacgcgcgcgggctccggggtgttgagttcggggagattcgaaaaggcgcggggaggaagggggcggggccaggggccggagcgcaaggcgtgctctgattggccgggggcgaccggtcctcttttcctcgcccggaccaggccacgccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggtgggtatttcatttgcacaatgagttgtaggcagtattaagatggctccgggggcactgttgagttgaatctggaatatcttcttacagtttcggtgaaatgttaaagagtttatgggggaaaaattcttcacccttgtgactttgtctgattttaaaaatccaagagttttgtgaccgagaaagctcagttaacttgattttctggaaccaatatcatattcaggtcatatttcccaatgtttatttagtagattttgataatttttttcgtggttaatttagacgtctttattccacgtatttttctgacgaatgtatgtagatgtgatgtgagatttttttgggttgatgacatatagaaaggcaaagaaagtgattgcatgtttttgaaaatcattttcaggactttccttatcccagttgattgtgcagaatacactgcctgtcgcttgtcttctattcaccatggcttcttctggtaggtaatctatttggaaaatctgaaattgtaatgggcttatgattttagattgagatggctcaggtcttcgcctttgatttggcacttatgttttggtcttaccaaaacctattttatgaataggagaagaatttaaaaatgattatcacttgaatgtgccgagagctcgtaattgtttattggacagtttggcttagtctgaagcaaattgtggagtttgcacaagtcttttgtttatgaaagcgattgtcagatactgatgtctcaaaacagtatttattaatccaaaaatgttgagctttgtttttctgggagatggtttttattttttttgagacagggtctcaccttgttgcccaggctggagtgcagtggcttaattatagctcattgcagccttgacttctggagctcaagtgggctcaagcgattctcccacctcagcctccatagcatctgggactatcgacatgggccaccacacccacctaatcaaaaaaaattttttttgtagagatgggctttccctttgttgcccaggctggtctcaaacttcagggctcaagggatcttcccatgttggcctcccacggtgctgggattataggcatgagccatggtacctggccttgggaaatggtatttagataataatatcttgcctgcaaatacatcttcccctagtgtcagtagactgataggaataaaaaggggaaaaaaaacacaactttcctcatcagccctagtttaatacattaaattgatttgggttttagaaaattatagtacagtttattagaacaggagaatcctggttttctgaattataaatataatcaattctagatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacaccccgcccgaagagcctcagtgcttacactaaggagtcgtcttctatcgaatagtgtgagttcatggagtaggaggaagcaatacaacccaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagccttttccttgaaacaaatttttctgtcttaaatagtaatctacagacttagtcttgaatttcctatcattgttttatcagttatggttaaaatttttacaatgagctagttttctttgggtagcttttgaagttaaatagtgaaattctttacaataaaagtgccactcgcaagtacatattcctcaagtcatccagataccattaagcagtaaatcttacaaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgcaacctccacctcccgggttcaagcaattctcctgcctcagcctcccaagtaacttagactacaggcacccgccaccacgcccggctaatttttgtatttttagtataggtaggatttcaccatgttggccaggctggtcttgaactcctgacctcaaatgatccacccaccttggcctcccaaagtgctgggattacaggcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggttggtttcttactttgtaaaagggttgagcttggagtttgatgcaccaatgagttggcttgaactaagtgctttgataaaaggtgtttggtgtctttttgtcatccattttggggcttaacatattaaatgaaaggtatattttaagatggaatattcagtaattcccagcataattgcacagtccttggaagtccagtaggcagcttgttaggttctacaagggacccaggagatttgatgatgatgtctcagaacttaaattgtgtggttcccacaggctgtaatatatgcactgaggttgtgttgggcctctttgaggtgggggctgggggtcgtgacttgacagggctttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgactaaagggaaccttaattatttctaaagtagcatttgactcgggtggttaaggttggcagatacgtcatcttgtatccagaggctgtaatagtccccattgtcagtgctttgcctctcaattcagggaacgcctttggcagctttcctgtgctatttgagaaatagcctaattatacatattttgtgcctctcagacatctgtataaaagctcttggaagccaagcacttatagcaaaagatgattgctaatactgcggtggggtccatgtgttcgtaacgcatgtgcctctgctgcttgggctgtatcttgagattggggttttaccaaacttattcatgagaacaataacagcctacctcaacttacctcctaagattgttaggattaaatgggtttgtggcaagagagcacacttagaacatagatatttagcattccgtataaatcacgattactgttttcaaccagaggctaatgagtgatctaagtttatactcttgagttggaaattatgcagtttttatattccttaaattgacttttaaatttacttaaatgatcaatcagaggaattctgaacaaagctt

SEQ ID NO: 2328 - DNA, 620 bp, Homo sapiens
  Genbank Accession No. M31520
gggtttatcggaaaatgtgtttattgagatggtttcccactcatcttgactcagagtgcttttagtgctgcttcctcctgaaggaacatccttctgtaagccttgcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcatgtgt

SEQ ID NO: 2329 - DNA, 4396 bp, Homo sapiens
  Genbank Accession No. M31523
gcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggtgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaagccggactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaaggtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagccccccccgtccccccccccggaagccactgcacacagacagacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggccccagcggtaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactccttgccccagggacccaggctcatgctctgaactctggctgagaggagtctgctcaggagccagcacaggacaccccccaccccaccccaccatgtccccattacaccagagggccatcgtgacgtagacaggatgccaggggcctgaccagcctccccaatgctggggagcatccctggcctggggccacacctgctgccctccctctgtgtggtccaagggcaagagtggctggagccgggggactgtgctggtctgagccccacgaaggccttgggctgtggctccgaccctgctgcagaaccagcagggtgtcccctcgggcccatctgtgtcccatgtcccagcacccaggcctctctccaggtctccttttctggtcttttgccatgagggtaaccagctcttcccagctggctgggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctgcgccctgggagtttgatctcttaagggaacttgcctctccctcttgttttgctcctgccctgcccctaggtctgggtggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaattttttttaaagaaaataattgtatacgtgtcaacacagctggctggatgattgggactttaaaacgaccctctttcaggtggattcagagacctgtcctgtatataacagcactgtagcaataaacgtgacattttataaag

SEQ ID NO: 2330 - DNA, 1818 bp, Homo sapiens
  Genbank Accession No. M31627
tagtctggagctatggtggtggtggcagccgcgccgaacccggccgacgggacccctaaagttctgcttctgtcggggcagcccgcctccgccgccggagccccggcggccaggctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgctacagtgactgtggatacgggggttccctttccccattcagtgacatgtcctctctgcttggtgtaaacattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaatccctctatttgttcagatctcatagatgacccccaggtattgccttttgacatccagcagtccaaggtattgagacatattactggaagtaagaaatattactataattgagaactacagcttttaagattgtacttttaagattgtacttttatcttaaaagggtggtagttttccctaaaatacttattatgtaagggtcattagacaaatgtcttgaagtagacatggaatttatgaatggtctttatcatttctcttccccctttttggcatcctggcttgcctccagttttaggtcctttagtttgcttctgcaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaaactacccatgcaattaaaaggtacaatgcaaaaaaaaaaaaaaaaaaattttttt

SEQ ID NO: 2331 - DNA, 2388 bp, Homo sapiens
  Genbank Accession No. M31667
ggtgtggtgactcatgcctgtaaccccagcactttgggagtccgaggaacggtggatcgcttgagctcatgagtctgagaccagtgaaaccccgtctctgcaaaaaaaaaaaaaaaaaaaaatacaaaaattagccggatatggtgcctgtagtcccagctacacgggaggctcaggtgggtggttggcttgagctggggaggcagagagagtgcagtgagctgagatcgcaccactgtactccagcctgggtgataggagccggagggtgtctcaaaaaaaaaaaaagaaagaaaagaaaaagaaaaagaaataagcatcaaagttcagtttggttccttcccacctacccttcattgctttcaaagtcccctcacacttgtgttctcaacagaagtctccctcccccaggcacctcctcccagggcctctccagccctgaggtcccatctcctgctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttgggaggccggggttggaggatcatttgagcccaggaattggaaagcagcctggccaacatagtgggaccctgtctctacaaaaaaaaaatttgccaagagcctgagtgacagagcaagaccccatctcaaaaaaaaaacaaacaaacaaaaaaaaaaccatatatatacatatatatatagcagctttatggagatataattcttatgccatataattcaccttcttttttttttttgtctgagacagaatctcagtctgtcacccaggttggagtgcagtggcgtgatctcagctcactgcaacctccacctcccaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactatagatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgtttttttttttttgagacagagtcttcctctgtctcctaagctggagtgcagtggcatcatctcagctcactgcaacctctgcctcccaggttcaagtgcttctccagcctcggcctcccaagtagctgagactacaggcacacaccaccacgcctggctaatttttgtatttttggtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaactggaattacacaatgagtggtcttttgtgactggcttctttcacttagcacaatgtttcaaggcttagtgtgtgttgtggtgtgcgtcagtagctcttggtgcttagtctggaactggctaggctgtgc

SEQ ID NO: 2332 - DNA, 700 bp, Homo sapiens
  Genbank Accession No. M31994
ttctctctaggggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgattttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaatttttttaagtacaagttttggtcacagtgatttcttcttgtcacttaaaaacagtgttaaa

SEQ ID NO: 2333 - DNA, 397 bp, Homo sapiens
  Genbank Accession No. M32334
cttgccccctccctccccagagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggacttagccctgtgcccacagtgtctcctcctgggataacaatggccaggga

SEQ ID NO: 2334 - DNA, 2862 bp, Homo sapiens
  Genbank Accession No. M32405
ctgcagccttgacctcctgggctgaaggctcagcctcccgagtagctgggaattttttgtactttttattcttttatgtccgtgtgtacacaaatttttgtatttttttgtagagaggcagtctcactgtgttgtccttactaactttatatacaaaattttatctgttaaagccggaatggttcttttcacgaggccctgtccctgctccagtatctgtaatgaattctcgtgttcctcccacagtgggacctgaaccgccaaaccgcacctacgagcaaacggtaggcgctccataaatacttgttgatgtgggtgccatcgtgtagatgacggagcacgaacccgaggctcagacaggggcggcgacttgtccaaagtcactccgtggaggaagcggctctgcagacctcaggcggcggctgctctaatccctgcagcctgtgttttgccctccagacggcagagggcgcgtgttcgcgccgggaaagcggaacgcgtgtgcgcgcacggccgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccggttcttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatccgctgacgcccgatccgcgcccgcacaggcagaagtagagcagaagaagaagcggaccttccgcaagttcacctaccgcggcgtggacctcgaccagctgctggacatgtcctagtaagggcggccgcgggggtcgcgggcaggggctgggccagcggtggggcttgtccgggtgagggcggcggggcgggggtccaagcgcctctgcggcggtgggcgggcacggtctccgcgcgggtttggaactgagtgtggtcttgcgcccagaaaactgtccagagacgttgaggtttttgcttatttgcaacctgccccccgttgttcacttttccgcggcttagttggaaggtgtagcccctgtctgtagcccacgtgacttagaataaggggctgcgttagactccttagattttaagggcggtggaggtcggctgggtcctttccaggcagggtggtggtgggcatctgcttgcgcttttattttttaatttttgattattttgaggcggagtctcatcctgtcgcccaggctggagtgcaatggctccgtcccagctcactgcagcctcccactcccgggttcaagcgattctcttgcctcagcctctcgagtagctgggattagagggcccccccaccacgtccggctaatttttgtatttttagtagagacgagtttcagtgttgcccaggctggtctcaaactcctgacctcaggtgatccacctgcctcggcctcccaaagtgctgggattacaggcgtgaacaccgcgcccgaccttgatttttgattatttgtggaaacagcgtttctctgtgtcgtccaggttggtcttgaactcctgggctcaagcgaccctcccgcctcaacctcccgaagtgctgggatcacaggcgggagccactgcgccctacctgccttcccctgcgtttttagagcctttggcccgagctgtacgctgcagcaccttgtctgaggctgtggtctccgggccgcttgttctctctgaatctctgcagtcacacggtggctcttgcatgtgaggggtgagtcgcgcatatctggcgggggtgccagagggacttggcgtgttcattgtagtcactacaatggacagtgacaggtccactgcggctctgtccctggagagaaccaagccttagttctctgtccgccggagtgcgtagggtctccccaggccgggccgctcacaaaactgcctggtgcatcctccccagcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcactgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactccagtcctttgcgcacgttgttcttcctggcgtcccgagctctgggaggggcctgggcctgcttcaggttcgtggtgtgaggaggttcaggttggacgttcgggggtgtgtggtagtgttgtgtggatggtctctgtggtgtcgaagacatgacagctagtgcgggccctgccccaactcggctgcccctgctcctgtctgcag

SEQ ID NO: 2335 - DNA, 952 bp, Homo sapiens
  Genbank Accession No. M32886
gcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattcttggaactttaataagatctagtctgttacaccatttagaactttcctcagccattatcagtcatgccttattttcttgctaaaactctatgtaaatttaagtatgcaaaatgtttaagtcacattatttatttttcattgtgagatactaaaaactgttatcagac

SEQ ID NO: 2336 - DNA, 990 bp, Homo sapiens
  Genbank Accession No. M32977
cagtgtgctggcggcccggcgcgagccggcccggccccggtcgggcctccgaaaccatgaactttctgctgtcttgggtgcattggagcctcgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacaccgcggccgccagcacactg

SEQ ID NO: 2337 - DNA, 1268 bp, Homo sapiens
  Genbank Accession No. M33197
gttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 2338 - DNA, 1747 bp, Homo sapiens
  Genbank Accession No. M33317
gctaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaagttcagtgagtgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcagccacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcacggagaccgtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagagtcaaaaaggacaccaagtttcgggattttttcctccctaagggcaccgaagtgttccctatgctgggctccgtgctgagagaccccagtttcttctccaacccccaggacttcaatccccagcacttcctggatgacaaggggcagtttaagaagagtgatgcttttgtgcccttttccatcggaaagcggtactgtttcggagaaggcctggccagaatggagctctttctcttcttcaccaccgtcatgcagaacttccgcctcaagtcctcccagtcacctaaggacattgacgtgtcctccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgtggtgggatgagaggaagggaaaccttacattatgctatgaagagtagtaataatagcagctcttatttcctg

SEQ ID NO: 2339 - DNA, 1748 bp, Homo sapiens
  Genbank Accession No. M33318
gctaccaccatgctggcctcagggatgcttctggtggccttgctggtctgcctgactgtgatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgtaccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaagggcagggccaagaccgggcttgggagaggggcgcagctaagactgggggcaggatggcggaaaggaaggggcgtggtggctagagggaagagaagaaacagaaggggctcagttcaccttgataaggtgcttccgagctgggatgagaggaaggaaacccttacattatgctatgaagagtagtaataatagcagctcttatttcctg

SEQ ID NO: 2340 - DNA, 1635 bp, Homo sapiens
  Genbank Accession No. M34182
ctcccgtagtcgtagttcccgtagtatggcggcccctgccgccgccaccgccatgggcaacgcccccgccaagaaggacaccgagcaggaggagagcgtgaacgagttcctagccaaagccagaggagatttcctctacagatggggaaaccccgctcaaaacaccgccagctcggatcagttcgaacggctcaggacgctgggcatgggctccttcgggcgggtgatgctggtgaggcaccaggagaccggcggccactacgccatgaagatcctcaacaagcagaaggtggtgaagatgaagcaggtcgagcacatactgaacgagaagcgcatcctgcaggcgatcgactttccgttcctcgtcaagctccagttctcctttaaggacaactcctacctgtacctggtgatggagtacgtgccgggtggggagatgttctcccgcctacagcgcgtcggaaggtttagcgagccccatgcctgtttctatgccgcccaggtcgtcctggccgtccagtacctacactcgctcgacctcatccaccgcgacctgaagcccgagaatctcctcatcgaccagcagggctacctgcaggtgacggacttcggtttcgccaagcgcgtgaagggccgcacttggaccttgtgcgggaccccagagtacctggcccccgagatcatcctgagcaaaggctacaacaaggccgtggactggtgggccctaggggtgctcatctatgagatggccgtgggcttcccacccttctacgccgaccagcccatccagatctacgagaagatcgtctctgggagggtgcggtttccctccaaactcagctctgacctcaaggatctgctgcggagcctgctgcaggtggacctcaccaagcgcttcggaaacctcaggaacggggttggcgacatcaagaaccacaagtggttcgccacaaccagctggatcgccatctatgagaagaaggtggaagctcccttcatcccgaagtacacaggccctggggatgccagtaactttgacgactacgaggaggaagagctccggatctccatcaatgagaagtgtgccaaggagttttctgagttttaggggtgtgcttgtgcccctgtggttttctttcctttttgtttttggtggtttgggggatgggagggttggattgaacagccagagggccccagagttccttgtatctaatttcatcctcacccacctccagggttgggggagcaggaagcccagatatttggaggaacagaaacaccagctgctccctcacccccccccatgccttcctggtccctctgtgcttctctctttctcctccacaggtcccccttgccccagcccccttctgcctgttttaaacgagtttctcagctctattcaggccaggtcttgctgttgtatcaagggacacggtgtggaaagaggggctcaaacttaactccagccctgaacaggcaccacttactaagagaggatgaatgaaaagcacacctaccctttggcgtaatcctgcctgggaaggagagaggtttagtgccatgttcagtgggctgtttgctagaataaaaaattaaaacaaaaaacaattaaaatcttatttaagttcc

SEQ ID NO: 2341 - DNA, 1236 bp, Homo sapiens
  Genbank Accession No. M34276
agcctaaccctcacatgcatttttctctccctctgtatagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaattttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgcatggggagtcatgcgaaccgattctgttattgggaatgaaatctgtcaccgactgcttgacttgagcccaggggacacagagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtgacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaagagctgtgtttatttcattgacaaatagattatttgtattca

SEQ ID NO: 2342 - DNA, 4975 bp, Homo sapiens
  Genbank Accession No. M34309
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 2343 - DNA, 1104 bp, Homo sapiens
  Genbank Accession No. M35252
ctctagagtcgagatccattgtgctctaaagtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttaaaaaaaaaaaaaaaaaaaaa

SEQ ID NO: 2344 - DNA, 1387 bp, Homo sapiens
  Genbank Accession No. M35410
gtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatatggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaagtgtg

SEQ ID NO: 2345 - DNA, 638 bp, Homo sapiens
  Genbank Accession No. M35590
gcttctgaagcttctgggccctgcagtcccagctctgtgcaaacctaaccccgagcaacaccatgaagctctgcgtgtctgccctctctctcctcttgctcgtggctgccttctgtgctccagggttctcagcaccaatgggctctgaccctcccacttcctgctgtttctcttacacctcccggcagcttcacagaagctttgtgatggattactatgagaccagcagtctttgctccaagccagctgtggtattcctgaccaaaagaggcagacagatctgtgctaaccccagtgagccctgggtcactgagtacatgagtgacttggagttgaactgagcagctccagcggcagggcaggaggagccacttcaggagaggcctcctcagccctgatgcttctcactgagaagcgtccttgctcctcacgttcagatttcctgcccctcttcttaatttaaatctctgtgtagactttgttttgtttttttgggggagtattatttctattatttatgttttagttataggacgcgtgtctcccatggagatggtccaccattgctgtttctctgctattgtggatatgactgtgaaattgatttcatgcattttcataataaatctttctttaag

SEQ ID NO: 2346 - DNA, 10884 bp, Homo sapiens
  Genbank Accession No. M35878
ctgcagacctgggacctcaagaattgcatttgatgccgaacccagctctaatttcagagtcaaggtctctgcgagtatttaaggaacggatgtaaacctgggggattcgttttgtttccttcaattttccaatgaaatcagagatcctgttcttgggtgtcaacgcagatactagaaggaggtgatacaagagaaaggaaacagcaagcgacgattatggcacggtttcctgtaaacaaggttgagtgtagccacagcctgagcactgtgggagaagagctcataagaaaatgacggtgctgggccttcgtcaccccggggccctccattgttcttgtctttggtctctttttatttgtagaggtccaattatttatttatttagtacaagagggaacgaaattgatctttccattctaaaaggagagtatatatgtataaaaggaagctgtatagatatgggggaagaggtggacagggggaaaaggggagaggacgagagagagaaagggagggagagggacaaggagagacactgggcgagagatcgattaggagagacagaaatgatgaatgaagattaacttcacccaaggcttcgtcgctggaggggaatggaggagctcctgatttgctattactactccaaactgcaaagggctccttcaagtcacctatccacctcctaaggcaagcgtccaatttcaacagcgttcaggaaagtctcctcccgcggaggtctcaccgcttcccactccacccccacaaactctttggaaaagtgccttgaaaaatttaatcctcaatccaatcctggaccaccagcgtcctctgttggtcaccgaaggagggggtgcgcagacaaaactgaagaaactcgagtgccagagaaggccgacaggagttacagcgacctcagcgcgcaattgcgccccgaactttactgaaaagtgtttagattgcagagataagctagaatcccaacgcatcgagaatacagtaatacgaagtcgccttcaaaaaatgacaatgaaaattgcctattaaaggactatttggttaattacgtttcagcagtgcccagtttattgtctttattattcttttgtcgtgggtgtaaactccatttgaaaacataatcagggagaatacccaagacaagaagaacagttgtcatttaaaatatttgaaaagccctgccttaaggagcattcgcttgccggtccactcttaattggggacttgcggtgtagcaacacgtgagagtcttcttgcgttgagaagtaagcctggaaaggcgaaggccccggggcatcttcagatgcgtatttgtgggcccctggggatataaacagcccagcgggtgtaaattaaaccccgcagtgccttggctccctgagacccaaatgtaagtcagaaatgtcccaagacttcgcctgccaacggaattaaattttagaaagctccacgaggtacacacgaatgcggagcgctgtatgccagtttccccgacaccggctcgccgcagggagacctcaccccgagagcggaaggggtaagggcggcggggtcaaggagatcgggggtgctgagttggccaggagtgactggggtgaccgggggtgctgaggtggcctggagtgccggggtggccgggcacaccttggttcttgtagacgacaaggtgacgggctccgggcgtgagcacgaggagcaggtgcccgggcgagtctcgagctgcacgcccccgagctcggccccggctgctcagggcgaagcacgggccccgcagccgtgcctgcgccgacccgcccccctcccaacccccactcctgggcgcgcgttccggggcgtgtcctgggccaccccggcttctatatacgggccggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgccaggtgcgctgcgtgcagcaccgccactggcgccgaagggcctgggggttgctgggtgccgctgcgggagactccgcttttcttctcactggagataatatgtggggaaactgaaggcgctccgggaaaggtgaaggcggtcgccgagggaccctccccagccggccctctacttgctcgattctctaagtgcagagtacttgtaaattgcaaagcgctttcagtgaaaatgggtaaaggtttccggagctgaggggagcggtaccgatgtttagctgttggaaagatcctggacacaggagattctcctcgccccgcacgggtgcacacggactgcaatcccagggatgcttggggatggggggatataggcggatttggaccaaggaaggtgggtaggcacgttgtaggaaatagtacctctcttttaaaatactgactttgcacagccttttggtttgcaaagcaatgtctagtcccggtatgtccaaaaacaagtaaagtggattcgggttttgatatcttctgcggttggaaaacctgaagctgaaaaagaagtaacttcttaaggttacccagcggccacaacagagtgtaggtttgaactccgcgtgccactttcagtaccataccattcttacaactcgggccacccctgcacctgcgccgacctcaaacaaacttccaggtgcgtggtgggtgcgggcaatgtggactaagtcaatttcaatgacacggcaagggaattggaatcagtcctaggctgtctcccttcttaatctgaaatggggggggggaatgagatgttgttaaggggagccccagaagaggaaaaatgcaaacatttggcagagttaccctcttgcttagccactatcagtatcaggcagacagcgactctggtaagggcatcacattgttcccttaaaaaaaggagcgggggttgtttaaatggatttggcagctgttctttcaagcattcttagccagcctcacctagttatatgagaaataaagttcctgccttgcacagctgaaggctgggagaattctccccatcctaattcccccaactccccaacgatcacgttggacagatgtcactgggcaggcccccatctagggctagcaggatgaacagtccctttataatttatgtagctgtagagttccacgcccgggtgaagttattttctggctcggcaaggctggctctgttcacccctgagaaatgctggattcatggaaaggcaagatgcctgaaacatacactggctctggtcagctgttaaagctgctggaggcatttgtctctcggggcaaagttatgtcatttgccaagtgtcgtacattattgtgcattttggggtattcaaaaagtgatcttagaaatactgatacacatcgtcattcttgggctttagcaatcatcatgattaccaccttagtagcactgtagtataggttgatgtgagttataagattataaaaagatctaagtgacttctagaatctatttgacaaaaaaaggtaaattttcgacagtcaaaagtcacaattatctgttgcttaaatagaactgttttgtcttcatgccctagtctgcagcccaggcattaagaagaaaccaaggaaatttaagaaattactcaaggttcttagaaaagaagtataaatacgtttatttacatgttcttagagtatttacattcttagtatctcttttatctcagtatttccttgaaaaagaaagcaagctaagattaaaagaaattgaaaccaaatcctcgcaggtagggacctcctctgtgaggctctgtgctggaccctgggaatgtgtgcttcccaaggtatgaaaccccttggggaactttacagcaggacctcagtgagctgtttggcaggtgaggaaactaagacccagagaggagagggactttcctaaggccctggtgagtgacctgccagtagccacttccaggggagagcagagcatctgcagccaaatcattgcagccccaggtagctttctagatagactgtggaccagatgggccacctgagctccctgctagggttacacattatagccctgtttgtgtagtagagaaatttcatgactctcaattgtggacttaagccgatgcctccagaccttggcatggtccacaggccctgggagcatgggctctgaatgtagcctttgatccccatagcggtcttacagcccctccaagttcattctgaagaaggaatggagtgagaatcctggctgcagatccagtcttgaatttagtcatatacttaaaattccaattcaactgttaacattccagcatccattttaagcatcagactttcttcatttagcactttttattataaaagggagatctgctggagggggatttctcctaccccacccccacccagggaaggaaaagctctttggcacttagaagtctgagccgtgagtgggactttggcattgtctgcatccatgtgctgctgtgttcacccggggtgaaaaggactcacttaggcaggcaccagcaagatgcacagggtctgtgtagaccttgagttttagagatgtaacggggacctagaaaacaagccaccaacatgcttgcatgattctgagcccctgaggcaaaacgctttgcaggtaataattcagttttcccatctgagctggacaccaagctcttataagcgtgtttacctggtagcattgaggacggtactggtcaaccttggaattcccataagggcttgttacaactcagactcgtgccgccactccagcgtttccggagtggagaatgtgcatttcttccaagtccccgggctgccgctgctcccgcgggtgggaggaccacacttggagttgactgcaaaatttctgagccggcgctgcagcagcctcccgtggctcaggtctgccccctgccggtggaagatgaagcatactgccttcacctactgaggggcactgaagcgtttgtctgccttctttagttgcagctacttaggaagagcacctgtcagattgactttcaaacagataacttcttgaggtagagcaaccaccatgtagtgagtagtatgatggaataatacttcatcgaggtatttaaaaaaaaaacctcacttggattgccaactaatattgtcatttacatgtgacctggttgcaacgttaagatttttacaagactgtgatagatattgatgactctcatgtgtttgtctctcttgggcgttttaaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggctgatgggtgggcaacccctagcccctctgtgccctacctctctcctctccttacataaagaatattgacccttttggagaatcttatgaggatcaagctgaaataacactcttaaaagcatatgggatgtcataaagacctctgcagataatgaaaatattctcataaagatagttttatttacttcatcctctatgcttgttgacctgctattggttccatgccagcttctgtgccttactctgggaagagcaaaaaggagacagggagtgatggttagcttattcgggggactttcgtgctacatcagacataaggtatctgaggagcaaattacaggtcccacttttggtagttgtgcagcatcgtaagatttttaaagcacacattctagagtaaaaactgtgactctgttgctctggtccttcctgatccccagggtccctgccgtagagaaatggaagacacactgaatcacctgaagttcctcaatgtgctgagtcccaggggtgtacacattcccaactgtgacaagaagggattttataagaaaaagcaggtgagtgaggtcctcagtgtgttttcttcctcttctgttgacacagaggagaaacccatgtcaccagcgcccaggctcttgtggccatagctctaactctgagcctgtgcagcaccagtgcccaggacttggtgccagtctcaggaggtcagaccaagggctgctttgacttgttgctctgagtgctgctatattggccataatcctcaaccctagtgcctttccaccacccgcttcccactcctgtcctttcaatggttcacccacaggcggacaagatgctgcccagtggcaccctttataaactgcaagtggacatgttaacacatttgttaatgctgcgtcagggagtgacatttcaaacaactattatagtcagtttccaagaagtgtgacatgaggtcataccacaaaaaagcttaccctgaaatcccacaatcgtcccctttcctactgatgccttcccgatagtgagcaggttgcaatattaagattttgaaaaggctgttgctagatgttggtgactcgtgtgtctctgtctcccttgggcttttcaaggaaatgctagtgagtggggggatgactgcagcatggccagcttggagagcccagccatccccagcacataccaggtgtctgtcttggcgtggaggggatggaacttgaaatcagacactcggtccatgctggggatggccagtctctccaaactggcatgtggtcttcctccgagtcactggcatttccctagaaagtccaagtgagaagaaggcatgagagtcatcaacatcaaacaacagtcttttcaaaatctttatattgcaacatagtcccattcctggaaaaggaatggagtgagaatcctggctacacatcagccccaaatgtagtcattgcctaaaatcccaattaacctgaaaatgatcaaacaaatttaagatatagtaatattaagctgtaataaatatgcttctataggctttgtgttatgtgatggcactatttcaattggctttctaattggacaattgatactatgctatctacagaattggcctttggagacctaagtgagccacagtggcctcagggtgaccatatactaggattcatagcagtggccacagtcagaagcctaagctttcctccattgccattgctcgtttataccacgtttctgtcaaagtcatattcattcaacaaagtcatactgagaaggtgtcatgtgaggctggatgtgggctccaaagtcatagctgtgacattcgcaggcagcgggatgttctcagttccacatttggcagagaagtcagtcaagaggttctacaagggctggtgtccaccttatactcctagaaacacaaaactgcccccacccccgctttcttggagcaggaagttacacccacacgcatgcacaggcgcacactcagcgggcctaggcagcgtggctcttgtgttgccttagctgaaatttctgttgtgctttctcagcatagcagagtcacgctggcaaaccatcatgcgccctggccaccgacctgacaccagacccaggagcattcacttctctgtcttctgtttctctcccacagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctgggctccagggcctcactgtccttggaccagcctcaggggctgggcgtggccactggccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgagtctggaggtcatttatcttcacagagaacgtttatcgcagactgctaagatacatgttctaattaagatgtgatgtgagaacgctgaatgctcgttggagactcagttgaagtgcagctttttttctgtcaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatttgcatgtttagttataagggtttcttttttccttacaagttggaaaaaataattctaatttaagggtaactctttgacaatgaacactgtgagcagcatctggtactcgttgctttgtttgaaaacatgagttgagaccccagccgcacttgcagcctagtgccattagcctgcaggctgtgctggatatctcagggcaagagtcgagcccttttgattttggggggattatttcaatatatttgctttttctttttgttttagttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacgggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattaaaatgttccctgctttcccttttagcaa

SEQ ID NO: 2347 - DNA, 891 bp, Homo sapiens
  Genbank Accession No. M36072
tttttttttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttc

SEQ ID NO: 2348 - DNA, 1941 bp, Homo sapiens
  Genbank Accession No. M37400
tctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaagctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaag

SEQ ID NO: 2349 - DNA, 873 bp, Homo sapiens
  Genbank Accession No. M37583
cagtttgaatcgcggtgcgaccgaaggagtaggtgctgggatcgtcaccgtggcaccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgttcagaccttatttccactctggtggataagttcaataaaggtcatatcccaaactaaaa

SEQ ID NO: 2350 - DNA, 649 bp, Homo sapiens
  Genbank Accession No. M38591
agaatacactcacaagccactccgctgctcgcctctccgccccgcgtccagctcgcccagctcgcccagcgtccgccgcgcctcgccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 2351 - DNA, 1192 bp, Homo sapiens
  Genbank Accession No. M38690
cgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgcttggtttatatttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgaaaaaaaaaaaaaaaaaaaaaaagg

SEQ ID NO: 2352 - DNA, 1447 bp, Homo sapiens
  Genbank Accession No. M55150
agtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgc

SEQ ID NO: 2353 - DNA, 3612 bp, Homo sapiens
  Genbank Accession No. M55210
aagcttaaagtgaagacttgctgaaattatttcagcattttactcctggccattttccataggaaggctcctaatagtgtctaactcctgaaagcagaaagtgaccttcaaaactgacccatcttccctggaatctctctaagagctgagggattagggttcttagagatttgtgtatctttgatggcactaaaatgacatagagtttacatgtatacacctggaaaaggtattaaatgttatcagatggccctcaaaggtctagaacatggtagctgtgcattgaggaaacattctgcaaaaaccattgtctcagaaagaaacatccagctctatattaattgtatgctcagacccatccctgctggttaggtcagcatttgtacttggtttgcatattataccattgtgtgacatcaacaatctgcaagtcacatttgccgggctgcctgtgcagaatggcagctgctgggcctagagtctagtgcaggtacttgtgaagggatcattcttactgaatatgtctgttctcttctatgtactttctgaccctccagggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccatcacgttgctaccttacccacacttccctctgatttgcgtgaggacgtggcatcctacttacgtacgtggcataacacatcgtgtgagcccatgtatgctggggtagagcaagtagccctcccctgtctcatcgatccagcagaacctcctcagtctcagtactcttgtttctataaggaaaagttttgctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagctattatgagtgtaggacactgagccatccgtgggtcaggatgcaattatttataaaagtccccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggctggggtggggggaaagaaacctattatcatggacacactggtgctattaattatttcaaatttatatttttgtgtgaatgttttgtgttttgtttatccatgctatagaacaaggaatttatgtagatatacttagtcctatttctagaatgacactctgttcactttgctcaatttttcctcttcactggcacaagtatctgaatacctccttccctcccttctagagttctttggattgtactccaaagaattgtgccttgtgtttgcagcatctccattctctaaattaatataattgctttcctccacacccagccacgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctggcttctcccaggcctcttctactatggcaggagatgtggtgtgctgttgcaaagttttcacgtcatcgtttcctggctagttcatttcattaagtggctacatcctaacatatgcattggtcaaggttgcagcaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaattcttttccttggaattccaactgtggaccttttatatgtgccttcactttagctgtttgccttactctacagccttgctctccggggtggttaataaaatgcaacacttggcatttttatgttataagaaaaacagtattttatttataataaaatctgaatattttgtaaccctttatatt

SEQ ID NO: 2354 - DNA, 2867 bp, Homo sapiens
  Genbank Accession No. M55513
ttttcggctgcttggtaacgggctgccagaagagagaggcagagagcagggcagcggcttcttgacgtcagggccaagcgaggggatgcgcgccagcaacccccagctctccccagagaggggccggccgaggctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccggcctgcgctttgagacgcagctgggcacccaggcgcagttccccaacacactcctgggggaccccgccaagcgcctgccgtacttcgaccccctgaggaacgagtacttcttcgaccgcaaccggcccagcttcgacggtatcctctactactaccagtccgggggccgcctgcggaggccggtcaacgtctccctggacgtgttcgcggacgagatacgcttctaccagctgggggacgaggccatggagcgcttcggcgaggatgagggcttcattaaagaagaggagaagcccctcgtccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggccccgccctctggccctacggtggcaccgctcctgcccaggaccctggccgaccccttcttcatcgtggagaccacgtgcgtcatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggcggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttgtgaaaggagattcaggcagactggcagactggtggcagtggagtagggaatgggaggcttgctgaacatggatatctacattataccgcagagtattgagtcacactgtaacctcagtctacccctctccttcactcctttcctccctccctcggatccccccattttctctattctttccatgaacacccaagggtcgcctaatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccatgtgttccaaatttgctttacatatgattgtatttgtgtataggggaaaatattatttttatgcctggtaagtggctttttgtactgtagtcagatagagatatttggtatatttcaagatacatgttgtatttatggaagaatgtgttggtcctgatggtttttctgtgttactatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgtaactttcttcaaaaagcattttaatgatattggaggaatacttctgataatttattgtctttatttttatcccaggaaataaaaggttaccttgtt

SEQ ID NO: 2355 - DNA, 1551 bp, Homo sapiens
  Genbank Accession No. M55671
ggtgggaatggcaggctgcgtcccactgctccagggcctggtcctggtcctcgccctccatcgtgtggagccctcagccacttcactgaaggaacgacatggactccattctgactctgcctgcacaggcgtccaggaaagcttatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacgtgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcat

SEQ ID NO: 2356 - DNA, 2252 bp, Homo sapiens
  Genbank Accession No. M55998
aattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaaaaagaataaataaataagtttttaaaaaaggaagcttggtccacttgcttgaagacccatgcgggggtaagtccctttctgcccgttgggttatgaaaccccaatgctgccctttctgctcctttctccacaccccccttggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcatcccttgtgccgcaggctgggcgggagagactgttctgttctgttccttgtgtaactgtgttgctgaaagactacctcgttcttgtcttgatgtgtcaccggggcaactgcctgggggcggggatgggggcagggtggaagcggctccccatttttataccaaaggtgctacatctatgtgatgggtggggtggggagggaatcactggtgctatagaaattgagatgcccccccaggccagcaaatgttcctttttgttcaaagtctatttttattccttgatattttttctttctttttttttttttttgtggatggggacttgtgaatttttctaaaggtgctatttaacatgggaggagagcgtgtgcgctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggccttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 2357 - DNA, 914 bp, Homo sapiens
  Genbank Accession No. M57710
ccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaaaagaatctaaaccttacatgtgtaaaggtttcatgttcactgtgagtgaaaatttttacattcatcaatatccctcttgtaagtcatctacttaataaatattacagtgaaag

SEQ ID NO: 2358 - DNA, 1480 bp, Homo sapiens
  Genbank Accession No. M57730
gcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgtcaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggacggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgg

SEQ ID NO: 2359 - DNA, 1065 bp, Homo sapiens
  Genbank Accession No. M57731
gaattaggcacgagagctccttgccagctctcctcctcgcacagccgctcgaaccgcctgctgagccccatggcccgcgccacgctctccgccgcccccagcaatccccggctcctgcgagtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggagccctgccttacaggaacagaagaggaaagagagacacagctgcagaggccacctggattgcgcctaatgtgtttgagcatcacttaggagaagtcttctatttatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaagatactgccttgtttaatgttaattatgcagtgtttccctctgtgttagagcagagaggtttcgatattta

SEQ ID NO: 2360 - DNA, 2111 bp, Homo sapiens
  Genbank Accession No. M58286
gaattcgggggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccgctggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaaaaaaaaacccgaattc

SEQ ID NO: 2361 - DNA, 4330 bp, Homo sapiens
  Genbank Accession No. M58569
tctaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttgtaaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagc

SEQ ID NO: 2362 - DNA, 15849 bp, Homo sapiens
  Genbank Accession No. M58600
gggctttgcatgtgtgagaacaagacagagaatgagggaggtgggccccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcaggaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacaacatacttaacttaaaccaatcgggtcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaaccccacagcctggcagat

SEQ ID NO: 2363 - DNA, 2849 bp, Homo sapiens
  Genbank Accession No. M59499
cacattaatttattcctcttcctcttataggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagaattctattatgtgcttccctccttagacatagtttttctccttttgtactaaccagtacttccatctatattgagctaaactgtctttgaacagtcaactctgcatcatgtgcctgcctgatttggattggtttcactttttttttgtttgaccatagcccattctatcagtcaagatgactgaataattgtgtgttaaatacaactcatgataaggagaacctttatggaaacaagaagttttatggaaatcgagagagaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgctttttttttttttttcaaaaagttcacccaatccctaggctttttacttttttctttttcttttcttttttcttgtttttttttttttcattttgttttgttttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacactgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagattgcttgaaatgtttaatgcatgtgaacgttatttttaccgtgttttggaaaaagatcttgatgttattgtcttcctttattttccacaattaagtgcatctaactgtgaattgtatatggaattacattattcagcatatacactatatttacctgctttgttcattctctgtattcaaaattaacagatcatgctgaaaaccactcaaacgattatattttttacattataagaagtaaaatatattattctgaataatgaaacctggctgttgtactcgtaaagattttagt

SEQ ID NO: 2364 - DNA, 13048 bp, Homo sapiens
  Genbank Accession No. M59815
aggcctcttgtggctttccacaacttattgtcccatatttttatggccagtttatacaggcaccccacaagtccttttcccaacacagacaggaatacggcagcctgtgccctgggagctcactgtcttgtgggagggaaccactcaagccactccccacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgaagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcatttcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataagggaaggaggaaggggcctgaggggaccagctggaagagtccgggcaggaagggctgggcaggggaaggggaggaggggaggaggccgagtgctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctgcctctctgcccctcggctccttgctgaacccacgtgtggtatttggggccagagatccgaattccgggattacgagtggaaggtgggcagctctctccagcagcctctcttatgttgctggtctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagctggactgccgggagcccttcctgtcctgctgccaatttgctgagagtctgcgcaagaagagcagggacaagggccaggcgggcctccaacgaggtaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccaaaccaatgccttggtctgttccccatcttctacaattctgatccaactctgtccctggagttgaaactcaaagttctgggggagtctgtgctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacctgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttctggaagatggacagcccaggaggcttacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggacagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggaggtgaggggtgaggcgctctggcagtgagcctgaggcccaggggacttaggatcctgagtgtgcccagagggagaggctggatgaagactcagaggaggaatgaagttataagcaggggtgggttgggggagactcaggagagcccagcagggggtggctaagggccaggggaccaggctcttctccctgccttcctgtttacttgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggggggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggcctgttttgaggaaggagataagttattggagccgcaaaaacaggtttgcttgtgcccttctaacatcgccttcccttttctcgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcctgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagccgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacactctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaacggatggagctgcaagttcagtttgggaatcatcagcctggattggtttggtggaagccagggagtggttgagaccccacaggggagctctgaggaaggaagttccgaaggagggaacgtaagaaatgaccaggtcagaaccaagggtggtccagaagctaacccttagcttagggacagtttcacagagaacacgtccatgatgcaagactctagctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggctgaccctccctcggggaccggccgttttggtctctctgggttgtagcctgctcctcttatcatggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagaccagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagcttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcagtgacagttcagcagcctgcatccagtcattcgacagaaattcgggaatctttcacttcatgccatgccctgtgccaggtgccagagatacagctgctcactccaggctcatcgctggggagacagataagaggacgggcagtccccaccctctgtgaaagatgtgatgtcagggagcagtgtggtcctgtggggcatctaaccaagtcaggggcattgccaggcagggaagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatc

SEQ ID NO: 2365 - DNA, 2373 bp, Homo sapiens
  Genbank Accession No. M59916
gaattcgggcgggggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcatacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccaggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagcccgcccgaattc

SEQ ID NO: 2366 - DNA, 990 bp, Homo sapiens
  Genbank Accession No. M60784
ccctagtaaacatgaggatggctgcttaatggagaaagaagtatggaatgagaagagggaaattagagaaacagcatatcagaaaagtgagggtaaggccgggtgcggtgctcacgcctaaaatcccagtatgttgggaggctgaggcaggtggatcacttgaggtcaggagttcgaggccaatgtgggcaacttggtgaaaccccttctctcctaaaaatacaagaataaaaatggaaaaagtgagggtattggttatttttttggtgtggcgggtgggttatgatttaggaagggcccaggagactgcggtgtactgtttattgatttaggttgcagttgcatgggtgtttgtgtttaaatttttcattaaatgctatgtttacattagagtttttcaacttagtactatctgcattttgggctggataattctgagtaatggggccctgccctgtgcattggaggctatttggcatcatttctggcctctgtccacttgatgccgttacgttagggggaaatgctgagtccctgaggtctgtcgttctctttcaggttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaatcatttgtctgtctgattttctttgctcttcatggttcctttccctcacc

SEQ ID NO: 2367 - DNA, 538 bp, Homo sapiens
  Genbank Accession No. M60854
gcgccgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagttt

SEQ ID NO: 2368 - DNA, 1343 bp, Homo sapiens
  Genbank Accession No. M60974
ggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatt

SEQ ID NO: 2369 - DNA, 2258 bp, Homo sapiens
  Genbank Accession No. M61853
agtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcatgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctatgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactataaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaataatggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggc

SEQ ID NO: 2370 - DNA, 1746 bp, Homo sapiens
  Genbank Accession No. M61854
cttcaatggatccttttgtggtccttgtgctctgtctctcatgtttgcttctcctttcaatctggagacagagctctgggagaggaaaactccctcctggccccactcctctcccagtgattggaaatatcctacagatagatattaaggatgtcagcaaatccttaaccaatctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcattggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaataga

SEQ ID NO: 2371 - DNA, 1854 bp, Homo sapiens
  Genbank Accession No. M61855
gagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagataccttgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggttttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgaccttcattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgaaaaaaa

SEQ ID NO: 2372 - DNA, 5613 bp, Homo sapiens
  Genbank Accession No. M61916
cccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggtgatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatgagttaaataaagccc

SEQ ID NO: 2373 - DNA, 1955 bp, Homo sapiens
  Genbank Accession No. M62403
gtgccctccgccgctcgcccgcgcgcccgcgctccccgcctgcgcccagcgccccgcgcccgcgccccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttct

SEQ ID NO: 2374 - DNA, 428 bp, Homo sapiens
  Genbank Accession No. M62486
tcttttaggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtat

SEQ ID NO: 2375 - DNA, 1361 bp, Homo sapiens
  Genbank Accession No. M62895
cattcggggacgctctcagctctcgactcactgcccagcttccttcaaaatgtcaactgatctcgaaatcctgtgcaagctcagcttggagggtgctcactctacaccctcaggtgcatatgggtcagtcaaagcctacaccaactttgatgctgagggggatgctttgaacattgaaaggaccatcaggacaaaaggtgtgggtaagttcaccattgtcaacattttgaccaacagcaggaatgctcggagagaggatgttgcctttgcctagcagagaaggaccacaaaggaacttacatcagcactgaagtcagccttactggccacctggagacagtcattttgggcctattgaagacacctgctcagtatgatgcttctgagctaaaagcttccatgaaggggctgggaactgaggaggactccctcgttgagatcatctgctcaacaaccaaccaggagctccaggaaattaacagagtctacaaagaaatgtacaaaactgatctggagaaggacattatttcggacacatatggtgacttctgcaagctgatgtttgccctggcaaatgttagaagaccagaggatggctctgtcgttgattatgaactgattgaccaagatgcccgggatttctgtgatgctggagtgaagaggaaaagaactgatgttcccaagtggatcagcatgatgaccgagtagagcatgtcccacctccagaaagtatttgataggtacaagagctacagcccttatgacatgttggaaagcatcaagaaagaggttaaaggagacctggaaaatgctttcctgaacctggtccagtgcattcagaacaagcccctgtattttgctgattggctgtactactccatgaagggccagggggctcgagataaggtcctgatcagaatcatcgtctcccgcagtgaagtggacatgttgaaaattaggtctgaattcaagagaaagtatggcatgtccctgtactactatatccagcaagacactaagaacgactaccagaaagcactgctgtacctgtgtggtggagatgactgaagcccaacatagcttgagcttccagaaacggtgctccccacgcttccagctaacaggtctagaaaaccagcttgtggctaacagtccctgtggccgtccctgtgaagatgacattagcattgcccccaacctcattttagttgcgtaagcatagcctggctttcctgtctagtctctcctgtaagccaaagaaatgtacattccaagcagttggaagtgaaatctatgatgtgaaacactttgcctcctgtgtactgtgtcataaacagatgaataaactgaatttgtacttt

SEQ ID NO: 2376 - DNA, 1133 bp, Homo sapiens
  Genbank Accession No. M63509
cgcagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaatgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggcaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaaaaa

SEQ ID NO: 2377 - DNA, 893 bp, Homo sapiens
  Genbank Accession No. M63573
gggtttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaatataaaaaaacccccc

SEQ ID NO: 2378 - DNA, 6074 bp, Homo sapiens
  Genbank Accession No. M63967
ctgcagcctccattcaaagagcaggaagccaggtcaaggagcggctacagccacagcggccggtccacagccagaaagctggagaagggacaaggaatgctgccgcagaacatctcccatttctgctatcctgctagtgccaccctacaggggcaggacaataccctccaatgcgtgcccgccttccacatccggcagagtactactaattggcagcacctagtccacatccagaactctaactgcaaatgaggctgggaaacatggcggttagctttgggacctccctagccagaaggaaggtgcagcgagggtggagcgagtgagatgcatgttcagtggtccatcttggcaacctttatagcaacaaaatggagacaattaaatgtccaacagtttacccctacaacagaattctatgccaccttggagaggatgatgtcatctgtaattagtgataggagaaaacttcaaaatacagcgctaagtttttaaattttttttaaagcagcacaacagaggttactatatgattttatttttattaaaataattttgaaagatgcagaggaaacaatactagcaggacgaacaccgtaataatggctaccgtaggtgaagagattacaggtgatatttttcttcttttttcatcctttcctgtgttttccaagctctactgcataccttctttttgtccttaggacaaaaatgtactttgaaaaatgcccaaatataaaatcttcttgaaggaactgaagaaaggagcaatgaaagtggaggacagaaattagtgaatcctggacaaaaaaagtgagggagaggcgaggcagagaaggggttaaggggagtctcaaggatggcagtcgattaagcagcgtcttgcagcggggagaaatgcaaagtgtagttggggatcggtctccgaaaactttgctgtgtgacctggggaagcccctgcccctctctgggtatctctgtttccgctcccaaaccagtgccttaggaccctagatctgagcaacgtggacactgggcttgcggagacccgagggagggagcgctgaagcggtgcgggctgccgggggtagaggggcggggaccgggaaagaccgggctgggcgagggaggagcggccttggccggcgacaggacgtaggagcgccccaggcgcagcggagcctcattggccgctgagccccgggctgcgcggaggcgggacctgcggccagccctgggcggccatgtggacagagctgggagggccggaaccagaacccaagcgtgatcctgaaccggagcccgagcctgctgcaggtaactaacgctggtctcccctcggctccctcgggaagccgcagctcctggctccgcgtggggggctttcctctctgggccgcgtcgacactcttcagagttgtagcttttcttctcagctgcctcctgacttgctgcacctctgggaaagctgaaaagggattctgagacctgtggttgggggatgctgggctaggtcaatttctgaggcacggccagttctgatgtcctgagtggagcttgccagggtttttatatgcaagacatcattcaacataaccccatgaggcatttcacatatgggggaactgaggcagagaggtgaaatgaagcaagtccctctcagagaacaaccatctcaccgtccctttgatttctactcaagtcttaggtcaattcttagacagcctttgtggcaatttcagtgttttctcagtgtatcattcagtactgtgtgttgagccgctgctctgtagcaggcatacctctaggctcggggacatagcagtgaatggaacagaaaaataagttcctgtgctcatggagcttgcattttattggggggagacagacaaacatataagcctgtaaagatagtatttgggatgtgagatagagaaggagtaaagcagggtagcggggatagagagtgttggggtgggaagggttgcaattttttaaagggtggtcagggaaggccttgctgagacagtggcttttgagacccagcagaggtgagggagtgagctgaggataggcgggacttgatggagttggcccagagagttcatcagggccctcacagctcttacagtctgtgtttttagaggtgacagtcctttatgctggaatcttgaaatgtttgagctggtgggcccttgggtaccgccacctgccttctcccacctgttcaccctggtttcttttgtccctctccagagtgtcagcatgctgcgcttcctggcaccccggctgcttagcctccagggcaggaccgccctctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatgcatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaaggcagctgtcagggaggcccagtcacagtccagcaattccacaaccaccttgacgaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggtttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccgtcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccagcggatagaggagtaattgttagtgggcatgggatttgtttttgggaggttttgaaaatgttctggagttgaacaatagtaatggttgcatgatttggtaaaaatactaaaaactatggaattgtttaattatgatatgaattaatttctttctttttttctttttttttttttttttttgacacggagtctcactctgtcgcccaggctggagtgcagtggtgtgatctcgtctcactcgaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaatccattttgtctccatattgtcctgctgctgaacattttatagagtgtgggggatggaaggacccaggtggtctagtcgaccagtcaggtgcaaaatcccctccccaatgtttctgtttttgttttctcttggatgggtgacaaagtgcaactgtaagacccgtagagaaaactctggttcctgctcagaatgggcccatcttgttggactcgtttccacagccccccaccccttccaaaccatacccacccttcaagccaagcctagcatgggggccaccttgacatctggggatttccagagtttcaaacctcagagttcataatgtttattgttagtcttgctacattcattccccaactgatgggagtgaaggcaaatccaagccagccaggccacaatacagaagcagaatgctgagcctccctctctcggtccatctttctagaccatgctgcttacaagccaccttacgttcaagtccccccattcctgtaaatgcacaccccactcatctctgcttcccaggctcaagcaatcctcccacctgagcctcccaagtagctgggactacaggcactcaccaccatgcctggctaattttttttttttttttggtattttttgtagagatgaggtttcaccatgtttcccaggcttgtctcaaactcctggtctcaagcaaccctcctgccacggcctcccaaagtgctggaattacaggcatgagccaccatgcctggccccagtcacatcctattgtcttacctaggcaacatgatgattttgtttattatcataacttgggtttggctggaaactgctgcttgagggttcagagtctgtttggttccctcacctcccttcctaggacctcctttctacaccatttgtctac

SEQ ID NO: 2379 - DNA, 3541 bp, Homo sapiens
  Genbank Accession No. M64174
tccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaagacaagaaggatgaggagaaaaacaagatccgggaagagtggaacaatttttcattcttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagtgatgtccttaccacaccatggaaattcaaagttgccaaacagctggccagtgccctgagctacttggaggataaagacctggtccatggaaatgtgtgtactaaaaacctcctcctggcccgtgagggaatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttccagaaaaaaaaaccagccaactgaagtggaccccacacattttgagaagcgcttcctaaagaggatccgtgacttgggagagggccactttgggaaggttgagctctgcaggtatgaccccgaagacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcagcttatgagaaaatgctgggaattccaaccatccaatcggacaagctttcagaaccttattgaaggatttgaagcacttttaaaataagaagcatgaataacatttaaattccacagattatcaa

SEQ ID NO: 2380 - DNA, 33206 bp, Homo sapiens
  Genbank Accession No. M64554
gaattctttttctggcagttcaggaatttcttcttggtttggatccattgctgatgagctagtgtgatttttgggtggtgttaaagaaccttgttttgtcataataccaaaattgtttttctagttccttctcttttgggtaggctatgtcagaggggagatctggggctcaaggctgctgttcagattcttttgtcccacggggtgctcccttgatgtagtattctcccccttttcctagggatgtgacttcctgagagccaaactgtagtgattattattacttttctggatctagccaccagaagggctaccaggctctgggctggtactgggggttgtctgcatagagtcctgtgatgtaaactgtcttcagttctctcagtcatggataccagcacctgttccagtagaggtggcaggggagtgaaaggaactctgtgagggtccttagttgtagttgtttgatgcactagtttggtgctggttggcctcctgctgagaggtgaagccagctggacttcctgggtcgaatggggacttggagaacttttctgtctagctaaaggattgtaaacacaccaatcagcgctctgtgtctagctaaaggtttgtaaatgcaccaatcagcactttgtaaaaacagaccaaccagcactctgtaaaatgggccaatcagcgggatgtgggcggagaccaaataagggaataaaagctggccacctgagccagccgcagcaacctggtctggtccccttccaggctgtggaaactttgttctttcgctctttgcaataaatcttgctgctgctctctttttgggtctgcactacctttatgagctgtaacactcaccgcgaaggtctgtggcttcactcctgaagtcagcaagacctcgaacccaccaggaggaagaaacaactccggacgcaccatcttttagagctgtaacactcactgtgaaggtctgcggcttcactcctgaagtcagcaagaccaggaacccaccagaaggaagaaactctggacacatctgaacatcagaggaacaaactccggacacaccatctttaaaaactgtaatgctcaccgcaagcgtccgcagcttcattcttgaagtcagcaagaccaagaacccattggaaggaaccaattccagacacactgccatgaggtagtgctttcatgagagcatcagctgtggtatataggggaggatcaggtggtgggtgggacactagaacttccaagagaatatgacctttgtcttcagctaccagggtgggtagggaaggaccatcaggtgggggcagggttaggcatgtctgagctcagagtcttcttgggtggggcttgttgtggctctgtggggaatgggggtgtgattcccaggttaatggagttaccttcccaggaggattatggctgcctcttctgtgtcatgcaggttgtcagggaagtgggggaaagctggcagttacagacctcacccagctctcacacaacccaacaagcaaatctcacttctactgtgttcccccaaaaagcaccgaatttgtttccaggcagtaggggagcaggattgagaacttgccccaggctactagcctcccagccgagaatgcaagccagacttttgtgcctccctacctgttaagtctgcacaccagattcacgccctttcctgagttctggacaggaaagtttgtgttcggttggaattgttactaagttcagctggaggtttccttctccctgtggtcttttcccagttcctccggcagcccctgtgagacaagtcagaaatggcttctctggggacccacagagacgacggggctttaccctttgcttcctctacccctgtatttcgctcagctctctaaattgtctgagctccaggtaaggtcaaatccttctcctgtgatctagaccttcaggttccccaagggtgtgtgttcaggggtggacaatacccctttcacacttttcacagtttgggcattcacagtatgtgggctattttctgggtcatgcaggagcaatgtactttcttcagagggtctgtggattatcttggctttcctgttatatccttgcagcagttcttggagcaaaagttcacaatgcgagtctccacatcctgctctgtccatccaagtgggagctgcaagttagtcctgcctcctatccaccattttttcctattttgtattttaaattaaaactcattagaatgtaaactccatgagggcaataattttaatccagttttttcactgctaaatacctcaaaactgttacatgtgctgccattatcatggacgttctaaacatttctcatgaatgaatgttgatatagcacagtgctgatctcaccacctgccacaaagtaaaaactctctaaatgtcaaatactactattataagtaatactattctatcattgagacaactatggttctgtatctctttaaggagtgcagtctaggcaacaacatatttcaacatcaggtatctgttatctcatgttcctaagttcatctttttacctgatcaatattagtaaagatctatggcctcaagtgaactttactctatgaatttacaattgggaacttaggttgaaaatttacctagtattatttattctgctgctataatttattatttattctgctgctattgttgccctaatcagttatcatgctcttactggactctgacatggtaagtaatgtcaattaatatagttgtgttattttaacattatttcaaaatattttaagtgaaatataagactcgttacaaaaggacttagacagaggttataaattattaactttttcctcaagagaagtattgtgtacttaatgacaagttcctagtgcttagaattgttaaaatctttgtgaagcacaccactgaagatgaggttgaaaaacctgacttttatcatcatattgataatctcaggagaactctatgcagaaggtaaaattaattcttaatattctttattctctaaaacatacaaatggagattctaatatttatacaactcaagttttaatatactcttctattttcattatcaattttataacatattttataaatataactttttataatatttagaccttttcctttgagcaaaattagtaaagtgttcttacagtagcataagtcagaaaagcaaaacaaaacaaaaacccttgtatctctagggggcataggagaccaggatctaaatacttcgaaaaggttttcaggttaacaatatgtccatttcgaagtcacatgttaactttaattctaaatttatgctagaatccattcctaatactgacaaaacttgtacaattttaattctgttcataaggtgagagtttaatgtgggaaatttgaaaaggaaatagccataaatattttttacttttgagactttgatttttatcacaatgaattattcatttgttggagacattaagtagtgattagtaggtgaaccatataattgcttgtacaaacagggacacttagagagtaaaagaggggctctattaataactgtttggacaacacatgtaaatcaggactttccaaacaaaccaatacctatggactccctattagaaagctttatagtcagattgcccaatgtgtaagattagtgtgcgagtggaagctaggcagtgtacatgggtatgttgttcaggaacattatcaatattatcaggccgtagatgaagaatccagggaggacacttagcattagcaagagtgaacatacaaagaaggaagctacagcaatacagcttttctaaaataaacatttttgggaatttgttgaaattaaatacataagttttaactgtgttttagttgaatagttaactataaattttctaccaaaacatctataattaaaattataaaagtgaaagacacagaattaatcttattttatacttttaattctataataggatgatttttgcatgaatttcttttgattttatttttctgtctaaatagggaaataccagcagatataattgtctgttatctataccataaagacattgcaatattctagttaattttctaattattataaggttataatgctattttacacaacaaaaaaaaaaagtaagctgcttgaagaccaagacaatgattttatttttgcatgcttctctcaactcccattgtgcacttcagggacaagaattgaattaattgtgtttctcatttcatggtatgcaagtattattggcctatgaaaggtctcactcttgctttacttacacattttatccccttattcctaatcttgaagtccatttcccctgggacctactacaatgttttaacatgttactctagctctctcaaccacaaatagctctggaatgaatatgtaatataaccaacttatctttctgtaagaatgtcatcagtctgtattcactcacagatagcattattgagtctattcttgtacttgatttctgtaatgagagattacttttgcagaatggcagttttgaagtatatcatctctgagagaggatgtaaattgttgctcctcatcattctcaccaacacctcatattgtccatttttgtactggttgctatatggttattcataaagtgatatcccatttttatttatttaccattctctgatcagtagtaagtgtgtccatcgcttcatgtactttttttaatatgttcagacatctgtgatttcctggtttatatgtgattagtatattcctcacatttctcattaattttttgtcaggaattcatattctccaaggcattccagctaccttaacaaataatgtgcctatcctggtggtggagggagatgtcccaggacagagagtctttaaagccacaacctaggattgttgtgcagagaatactttgctgcccctccctgacaagcaactgtgcccctcaggaaatggaatggggactatccagcccatgtttttctgtctgctccctttttattgtaaattcctttggtgcttgggtgtgaaaaaatggtgagaataattctcaaggaatggggactatccagcccatgtttttctgtctgctccatcagatagtggaagttttgttgctcatcattccacatccatttccttcaaacctaggctagcactactagtattttatgtctcatagtagcattaaggtatacagtgatcaaccaaggcattgaagccgtagtaatcacactggatccaggccttcttccatccatgactgcccatgtttcttcccaccacagctcctaggattgttcgagcatttctttcttttaagtgtttttatgactttaagatcttcaacataaagatatatttttaaaatatatgttttatttggagtataacatatccagaaaaatgcaaaaatcacaggatacacttatatagtttttacaaaattttacaccatccagatcaagatatagaacagtgatagtaccccagaaatatgatccttctaaggcactaaaccccaaaggtaaccattctgacttctattatcatggattagtttgttttcttttaaaaagttatgcaaatgtatacattaattcatatgtgattggcttctttcactcaatattatgtttatgagattcaccatttgttcatttctgttgttggataatattccattgtatgcatagtctaaaatgtgtttatcttttctattatttatgggcatttagattgttcccagtttgggactatatgaatactgccactataagcatttttttccatgtcttttggtatacaaatatgtgctttttttattgggtaatatggtttgtacatgttttaccccaatatatattgcaaaggtgttctctcatagagtttggactgatttatactttcagttgtagaaatatgcgagttccagtttcttcacttcttcacaatcattgagatagcttgtctttttcatttcagcagttctattggatatgcagtagtatctcatggtggtttaaattttcatttccctgatgactagtaatgctaagtaccaggtctctaaccatttaaatatcctattttgccaagttcttgccaagtattgctttgttttacttggttgtctgttttttcttttaatgctatttatttcaaaattttttatgagttagcatatgttaaggagaaactttatctattcctgaactgtactgtccaatactagccatcagccacatatagctattggagacagtacttaaaatgtcactagttcaagatcagatattctgtaagtataaatatgtagtggattttaaagagttagaaaaaaaaagaatgtaaaatattttcaatatattgggttaaataaaaacctattattaaaactaacttcaattgttccttagtatttttatgaatgtgactattagaaatttttaaattacataagtgacttacaatacatatctattaggaagtgcaggcagggtggagtggttcaagtcttgtaatcctagtgctttgggaggccaaagcagaaggatcctttgagtccaggagtttgagaccagcgtgagcaacagagtgagacccctcatctctacaaaaaataaaacaaaaattagccagatgtggtggcatgtgcctgcagtcctagctacaggagaggaggcttgcttaagcccaggagctcctggtggcagtgagctatatttcagcactgcactgaagcttggataactgaggaagactctgtgtctaggaagaaaaaaaaaagtactgttctacgaagttatgcaaagcttccctgaaaaagtggtctgctaaattttatcatgactgttggatgtttaaagtcatttgcagatcaattatgataaaaggactccttgagttgtcacaaaagtaccttaaaaatttaagtaagaaaaataagtactagttgaagtgtctctaaaaacttttagtttgtattgtcacctgattacaaatttatgtttttagatttgtttttccattttcagcttgacatttactcatttcagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcagtaagtcagctggatatgtcactcaatgtttcaatactcaaagaaatttgtatataaaaataggggtccaataaaaatggaaagcggttaaaccttttagtagataagaacaaaatcactagcaatctgtctttctacaaaatgaaggcataatttgaaatccagtaaataatgcttttacattaaaatgttattttctgtatctgtttttaataatactctgttgaagggaatagggtaataactgaaattatcatattgcaaggcaaagagaggtaatttactttaagtaacaagaaacttattttgataattaagcataggatgccagaaaaatgcttgaaactctggcctctggaagggcaagattgctactctaatgctttatcatttgtaagactcatctctcttcatgtgccaacttctctcatgatacccattgaaaaatgtgtttttcaattttgaattgaaagtttgagttcaaagttgtgagaaggtaatctaattgactcatttcattattttatatcaggctacactatcatcaaactatcaatgatcttccactagggcaggtgacccagagtaaggggctttggttgagccagtttcgtttaaaagaggatgttgaatatggctattgtggttgatatatctagtaaacctatctagaagtagatgtggtaggggtagaaattactataagaactaaaattagtaaatacaaagagagtcagtgttaaattgaatccattttcaaaaaaattatgcagatatttccaaaatgaaatcgccaataataacattatacttttggcttaattttacaatttagtaaaagacaagcttagtttcatcattaagttaaataattttttttcccatagaaaaatgcactaagcctgacctgagtaatggttacatctctgatgtaaagttattgtataaaattcaagagaacatgcattatggttgcgcttcagggtacaaaaccactggagggaaggatgaagaagtggttcaatgtctctctgatggatggtcttctcaaccaacctgtaggaaagaacatggtataagaatcatttcctaaactgaagataagtgcttatcaagcttatattgaatatattgaagcttatattgatatctattatttaatagaatttatttttcattatgtctacaatgcaggaagttgatattacattgcttttctcaagtactaggtgattccttaatccaaatgttctcaatccctacaacccacctacgccaatagttcctactttgcatcaataaaaggaattggaatggaataaaatgaaagaagctttttctttatatgtcactatttcctttattacagaagaatttaagatcatgtacattattttatattgtgaaccaatgtcagatatacttaaaaatagttcaataatttaaatatatgtatactttgttagtaagttgtttaaattgtaaaaatgcatagacagcacatactttcacaattgctactgcacaagcctttagttgaattttggcctttggtcaagcacttgtagactagaattttaaaaacagaaaactggtagagttaggtcacaaggtgtatgaagaagagaatagaggcaaagaaaaattggggctatttttcaattttgccaagagttgattttaccatgtattcttaagatttgtaaaaccatattttgagattttttataatctaggttattaaaaagtttataaaataaataatttttataattttagaaacgtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccagtaggttctcatttggaataaaatctactctcactctgaaagctttttctcatagagaagtgtatataagttgtcatgctcattatgtttcaccttttcatgcatttttgcctttatttttaattatgttgatagcagtctttgataattaaagctctcaagtagaataaattcattttagctcacagaattaaattagaataagcctaatgatatttaacaaatatataaaatgaattcataagctttttggcaaatttaatttctattctagttatgtcatgtaaatagtgcattttgttgtagcagaaaaaataaacatttgtttgtaattttattcattcttttatttgcagaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggtaaatttttaaatttaatactcgcaaaatgccatgtctttatcagctttaatctctattagctctgacaaaattcctgtggtcatatctattttttttcctgagtcctatttttaaaataaatattatcttttaaatcagtgctatttttagcaatctttaatatatcccacctgaataaatcttgttttgtcttagtttgtaaatgactatatcttttaaatttattattttaaaatatctattatacattttaaatcccttattataacgaataacttttcttattgggaattattaggactaattaccccaatctggcagctttgcaaggatattttctcttaatttgccacatatttccagatgtaaaaattaatctccaaaatagtgaggtagaaagcagagaaagcaggaaaagcagaagaatataatgcccagaagtgaaaatgggaaaagaggtcatcttgtaaaagctgcccaaaaatgtaatatctatggtcacatttctattactggaagtgtccaaacaggtaatgcaattacctgtcagaagacatccatagttatttaaacaaacctacaatttaatatgaggagggtcctatactagcagaagatatgaaaacagtaattgcagatatgaaaaaaataattgctataatgtgacaaatggtacaatcaactcaggtacaaagtgcaggaataaacattagagattctgattggtatgctgtggaatagcattcacagaagtgatggacaatatttaagttgggtcttaagagataagtagcagtttgagaattgggaggatagggtgaggcaaagggtttgatagtcattttttattttctgtaatatgggatataaggtctattgacaggcaggtgaaagacatgaaggtagaacttggaggaaagtggtgaagatttgaaacaggtgctaggggaaacaaatgagggctctgaccatgggtatgcagtgggattgccagaactatcataattccctaaatgcactgtacagtaactttaaagattttatgatttttcatttgtgctcgacatccttggtatagtagtagagaagtagattttttaagcaaatttttttaaagtctattattccttatttattttttatttttttgagatggagtcctgctgtgtcgcctaagctagagtgcagtggcacgatctcagctcactgcaacctccacctcccaggttcaagtgattctcctgcctcagcctcctgagtagctgggactacaggtgtcggccaccatgcccagctaatttttttgtgtttttagtagagacagggttttgccacgttggtcaggctggtcttgaactcctgacctcaggtgatcagcctgcctcagcctctcaaagtgctacttcaaaaataaatggcagacctacttaaggccttttatacccttctcctcttccaaattagccagcatgacaacatgcctgttttttccggtaaacagtcattaggcatacaatggctaatataattcagcccacaacaatataattcagttgtgggctgaattatatctctcttactcctcccaaaatatagccacattctaatactgagaaccattaaacgttaccttacacggtacaagacactttgaggttaacaatcttaaggtaggaatattatctggaactatctatccagactctaaatataatcacaaatgcttttataaaagggaggcagagggagattgactgcagaagaggaagcaggagatgtgacaatggaagccacaggttgaaatgttttgaggaaggggttgtgagccaaggaatacaggtgatttcaagaagctagaaaaggcaaagtagctgattctcctccaaagcctccagcaggaatgtggctctcctgatatctcgattttagtccagtgaaactgactctggacttctggcctctaggactgtaggaggataaatctgtgctgttttaagccactaaattgtaattcatcaaagcagcaataggaaagtagtgtggtcagtattttagagcaggagactttaatttagacagacgtgggttcaagaacagatctgctacatgctattaatttatttacttcataagttttagtttgtctataacatgggagaaataatagttcctacttaataaagttattttaggactaaaagaggtaatgaatgtaaaatgcctgctgtgttagtattctattggtgcgtaacaatgtcaccacaaactcagcagcttaaaacaacacaaagaaattatttcccattggtgtaggttgggggtctgggtgcggcttaaccgactccttgcatcgatggctatcaaagctgcaatcaagatgttagctggactgcagtctcatctgaggcttgactgggcaagacttcttccaaactcactgtagttattggcagcattcagtgctttgcagactgctgaactgagagcctctgtttcttgtggctgttaactgaaggcagccctctgccccttgccttgcagccgttctgctttggaagctcatgatgtagcctcttgtttcttcaaaaccagcaaggagagagagtctcttggcaagaatggcgttaaaaactgatgttacataattatgtgtgcataatcacgtactaatccatcacctttgctgtattttgtgggctagaagcaagtcacaggtcctactcatggaaaggggtatcacacaaggaagttaacatcaggaggtgaggatcaaaggaatgctcctagaatcagtctgccattctctctatgatgcttgacacgatgaatattttaatttaatctttattattttttgtaattatatgactaaaggtgctgattaattttttccataaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatcgacagaacctccaaaatgcattggttagtaacaccttgaagaagctttgctaaaatgaaatctgcatgtgtagctaaatggtcagttctctttcaactgtaccttttcagaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttggtatgtatgctacatttaccatcagtagctaaacttatggtgtaaaattttccattctgttactttaatctgaatattcctaggaaaagaccactgcttaggcaaattagaaacacattgctacagcacctactcttctgctttgcatgtgtgcatgtgtgtgtgcctgtatgtgtagctatctgtagaatttaagtcaatgtaaagaattcttaaacaaaagttttttttgaacgctagtgctaagcacggttatctgatctgtgtcatgccattacctgtaagttctaaatgacaacacataaatgacgatgtgcttcattagataagtaaataagggcatggtggattgagtgacgggccatgagcattatctacttcttctccccatatgtcctgcaaagttagggtagtgcattctgttcttgaccttgggtaagtcctgctgatattttgcatctggccattctgaaccttatgcccttctgagacatgtcctggtctttcattttactgaaaggcaccaccaggctacactatcattcctggagactactcttcctgtcatctatctcatttcttaatcagatcagagcaacatctccacacacatgtttatctaggatatttattaaataagacaaaagcaatgaaggatgctaaagaaatagataaagtgagagaaagataccaaaaagaggaaaaaaattgatatttccttcatgggtctattgagacctgagatgaagaggaatgaaaaagaagaaaataaaagtggggtaatgccaaagagcaattttagaattgaccataatctttaggttgaagaacagtttctcattctataggtttaagaaatgtgtatatcataattccttcacaattgagaaaagagaaaaatacgtatagttgtttttaggtaacatatttgctgtcaactcttgcttagcaaattttaaaaatatttgagctgaaaaaatttttcatatttgtaatgaatttataaaacaattgtcctaaattatataatacaaatatcgagacactatagtatgagttactatagtatattgttatgagctcatattaattttaaaacaacctcttttcttagaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttgggtaagaaagagaacacatggaatgtctacgtttgtacttttatgtgattttcttacagtgttttatatcatgaaaatgatgattttgtacaaatcttttttcacaagtgttttctctctcatttctttaagtagaaagtccctaaaatattagtgtattttttctattgtggtaaaatatacataacataaaatttaccactgtagctatttttaagtgtacaattcagtggcattagtatattaacatttttgtgaccaattagcttttgggttgtctttctcctagctgaaattccctccctggtatacagccctcaatatctctgcttgtattgccctcagaatgtcatttcaagaagaataattagtcctattctttccttggtagagtatattgctaatatattatagagtatattatatagagtatattgctaaattttaccaccgcatcctcatctgaatggacacgtttgttacatcttgttgattatataaaagtgtttgctaatgacttagataataaatggtcttctaaatgttttacacacacaagcacacactccacaaaatgctatgatatgatgcagaggtatatatcttagatttttttgctcaaaatatattgtaaacatggtttgtcatacttctacaatatatactttaatggctgcatagtattccataatgcagatatacatatgtaatttaaccagtttattgatggatgtttagtgttcaacatttttatattccaaacagtacactttcaagtaaatctttgtacatgttaaacatatttatttttgttaaaaataattatcatgagatcaggaattttaattctttttctattaattggcaaattgtctatcagaaagtttgttctgctttgttaaccctaccataagtgaattaaagtagtaatcatcctaatctttgttaactttgaatattttaatcttgacattttttgttaagcaggcaagcacaattattttaatttgatttatttaagaattaattaatttggaattttttaactttctagtagccacaggttttttacatgaattaattattcatagtttagccattttttcatacttataaatctatatataaattattttatccaattgagaatcatgtttattcgaattatttttaatttatttttatttatagtgtttttaagtatatataagtgtatgttttaagtcttgagctctttcaaccttttgttagtagtttccacctttcaagtaattcttaggagtcgattcccattcaaattcagatacagatacatattcacatagaattttgctattggtctcatatttttataaatgtttttgatattaagtttttgatgctttggttgatattgcattgagtggagatatagtaatctctaaggacaaagcctagattaaaatatttatggcaaagctggtaatgaaacaagctcataaggaaataacaacatttaaggaaatacatcattctatatctggaacaactgcctcaagagagttaggtttggtcctaatgaatcaaagcaaataccaaatgaagattaatcattgttatcagggcaagagaaaggggctttgtatatcttggtaactattgaaactggaaaggctatcagtacaaattcacaacagtatgataaagcgtagaattttctctgtaggaattattattccagacattaagagtctctctaacctctccatactctcttccctgctctaatcactccagtctttctggtctccttacttttccacaaacaagccaagaatgctctcacttcagggcctttgcactggttgttccctttgcttgggacactctttcataagaaaatgacatggttcactcagtctccttcaagcttttgtgcaaagtccccttcaagcttttttacttcttatttaggcctaccctaatcaccttactgaaaagtgcaacttctcttcacctagctcttttgttaccccctcctgctccagtactctttttttcatctaatttatcttatgctgtagtttaaagatggctactgtgttagtctgttctcatgctgctaataaagacatacctgagactgggtaatttataaaggaaagagatttaatgcactcacagttccacatggctggggaggcctcacaatcatggtagaagacaaaggagaagcatggaacgtcttacaaggtggcaagcaagagagcatgtgcagggaaactcccctttataaaaccatcagatctcatgagacttattcactgtaatgagaacagcatgggaaagacccaccccaggattcaattacctccaaccaggttcctcccatgacatatgggaattatgggagctacaattcaagatgagatttgggtaggcacacagccaaaccatatcagccacaaattatacaattcatgtctttattatatttattatgtattgtaggtgtttctcccagttagaaggtaagctccatgggagcaggagtcttggttttattcattagcaggttttctattattttctacatggtagttaaaggtttttattttatagaaagaaaattattattaatctaactgattgatgcccttaaatagtatttttgatgttttaaattaagtggttttagtttatgacaataatgtatagattcatttgatagtaataaagtatatattttcttatatatatatgtgtgagaagccttaattatgatttcaattataaaatattgcttttgaaacttgtcataatttttgttttaaaaaatatcacttttatatttgtcagacaagtaaagaatttaaaagagcattttgttttacagaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaaggtaaaataataatgttctctgcaagtatctttacttgaccaatatctgctacctcggttgaaaatttatttatagtttgttgctatttttcttattattattctttttaattttgttttattttattttattttactttgagttctgagacacaagtgcagaatgtgcaggtttgttacatgggtatacgtgtgccatggtggtttgcaattccagtaatggaattgctgcgtcgaatttcatttctggttctaggtccttgaggaatcaccacactgtcttccacaatggttgaactaatttacattcccatcagcagtgtaaaagcattcctatttctccccagccttaccagcatctattgtttcttggctttttagtaattgccattctgactggtgtgaaatggtgtctcattgtgattacaccttatacaaaaattaactcaagatggattaaagatttaaatgtaaaaaccccaaaccataaaaactctagaagaaaacctaggcaataccattcaggacataggcatagggcaaatacttaatgacgaaaatgccaaaagcaattgagcttgagagccaaaactgacaaatgagatctaattaacctaaagagcttctgcacagcaaaagaaactatcatcagagtgaacaggaaacttacagaatgggagaaaatttttgcaatctgcccatgtgacaaaggtctaatatccagaatctacatggaacttaacacaaatttacaagaaaaaaacgaacaacaccatcaaaaagtaggcaaaggatataaacagtcacttctcaaaagaagacatttatgtggccaacaaacatatgaggaaaaagctcaacatcgctgatctttagagaaaatttatacctatgaccccaattcaccaccatcatattctaatctataaagttgagaggagtgatccaacttccaaacttcaatcagcatatatacctatataggatggccatgctgacatcttttaattccaataagtcaattttatgaagggaaaaaatcaagaggttttataaatgttgccagactatcagagaattgatcaccttcttgtgagcactcaacaaccaacactgtaaagcattgctctacttagggctttctggggacccattgtctcagtactcactggctatagggactattacttttaataaggaagaaaaggaaaataatatatacagaaatcatggcttctagaaaaatcccatatacacttagggagaaataaaatcatgattgttaatactctcatagttttaaatatgcatgtaaacactataacgtgggattctaattataaaaatacattgtatggtataatattattgcaaaaacatcttcaatattttaaaaatatttgagaactgcctaaaaaatggctttatggctaggtgcagtggctcacgcctgtaatcccagcactttgggaggccaaggtgggcagatttcttgagcccaggaattcaagaccaacctgagcaacatagtgagaccctgtctctacaaaagaaaaatgcacctgtagtcccaactagttgggaggctaagacaggaggatcattgagcctgggaggcagaggttgcagtgagtcatgatcatgccaccatactccagcctgggtgacagagggagactctgtctctgtagcacttataaagtactggatgttcattatagcaattcattgtatactttaaaacttatttttgcagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttaggtatgtactactaaatatgcctctaacaaagtaaaactatatatttttaatttgctgtcatttttgagttaacataacactaatataatgctatatttgctacatttgtgttattttattcatgtgcttattttatcactgctttctattctttcctctagatcataaatacctatagttcagtttgttgtaatacatatttttttaaagacaaaccacacatcaggttggtatgggctataagttgaataagccatagtggtgtgagtaaactttaacaattatcattcattgtgattggtactataatagaaaacattagggaaacatgtataatagaaaacaatgcggaaataaagaaatggacaactcaatatggaaagatgaagcaagttaatgttttattagcaaggcatcctagtaagagtaacaacatttactaaggccctcagaggcatgaaatagcacatctgtaaataataagaaaatattttttatttccaattctgacttttatttacttctcttatcttctttcactggctaggacttcagtacaatgttgaatggaagaggtagtggatatctttatttgcttcccattctcataagtaaaacctttgataattcacctctatgtgttgttataaatatttttttaaaaatcaagttaaaggtataaaaacctttctttctattttgccgaaagtatttttaaagaatcttcaatctgtgtttaatttttagcaatatctgttgaaataattacatgattattacttttgttttttcccctgcaaatttaatgaattatattcgttcttttgaatgttaaagcatgattctatcccataagaaattccacaaggttgtgataaattatgcatattatatgttatatttttatttatcaatattttactcgatctattttcatgagaagactggttggttattttcctttctggtttgatatcaagtctgtgctgacctcatcccatgaatgggaagtgttccgtcttttctggttctctggattgatgctatttcttcctttataattttaagagttaaccagagaagccatctgggacttgagtttttccgtgaaaagacaaattgacagcttcgatttgtttaacaaataatggtaattatttcttcttctgtcagttttggtagggagtggtttcttgatggttcattacaactacattgtcaaatctactaacataaagtagttatgacatcttcctatcctctttttgatgtttttattgatgtatcttttgttattacttctattaatatgtatctgtcttgacatgccttgctaagggtctatacattttattagtgttttcaaaaaaccaacatttgcatttgttgattcatcaaattttgctttctattttattaattatgctgttatctttattatttcctttcttctatgttcttggatttcttttgttactctttttctggcttgtttagatgaatacatagattactaattttcagcatttatattttttctaatacatgaatttaaaaatagaaatttctctctgagcacaactttaacttcatccaaaccatttttatatcttggatttttactgtcattcagctcaaaaattttatagtattcattttgatatattctctgtgctctgaatcatttagaagtttctttttaaagttctgaatatttaggggattttctagttttcttttggttactgatttctagtttaattcaattaagacatactttgaattatatctgcactttaaaatttgttgatatttgctttataacaagcatgtatttgctttaggtaaatgttcttttcattgaaaagttaactttgtcattgttgggtcactgttttatatatgtgaattggattgagttttgtttttgatgtttaagttaatccaaagctgtactgatttgtgtgtgtttgttttctatcaatcactgagagaagcatgttaaagtctcacttggcattttaaaacattactaattttagttctgtccatttttgcttttgtattttgatactatttcattaggtacacacacaaattgagacactaaatcttcgtatcttggtgtattggcattgtctaattttaaaagacctccttcatatatagtaatgctttgcctttttttttgccttgaggtctcctttagctgcaccaaggggcttttgacaagcattcatgtagtacacatttttccatcccttaactttcaaccttctgggtttttacttttagtgtgcctctcttataagcaatatataccttattttaaaatatacttatgcaatttataattttttcccttgtaatggaatagtctatttacatattcatgtaattactaatatatttctgtttatacctaccaaccctaccaactttctatactaggtgtatgttactatactccatgtatatcccattggtcatctccctctttctctctctctctccatataggtgtgtgtgtatatatatatacacatatatatatataatattttaagttctagggtacatatgcacaatgtgcaggtttgttacataggtatacatgtgccatgttggtttgctgcacccatcaactcttcatttacattaggtatttctcctaaagctatccctcccccagacccccacagacaggccctggtgtttgatattccctgccctgtgtccatgtgttctcattcttcaacactcacctatgagtgagaacatgcagtgtttggttttctgtccttgtaatagtttgcttacaatgatggcttccagcttcatccatgtccctgcaaaggtatgaactcatcctttttaatggctgcatagtattccatggtgtgtatgtgccacattttcttaatccagtctatcattgatagacatttgggttggttccaagttttgctattgtgaatagttctgcaaaaaacatatctgtgcatttgtctttatagcagaatgacttataatcctttgggtatatacccagtaatgagatcactaggtcaaatggtatttctagttctagatccttgaggagtcgccacactgtcttccacaatgattgaactagttcatactcccaccaacagtgtaaaagcgctcctatttctccacatcctttccagcatctgctgtttcctgacattttaatgatcgccattgtaactggagtgagatggtctctcattgtggttctgatgaccagtgatgatgagcattttttcatatgtctgttggctgcataaatgtcttcttttgagaagtgtctgttcgtatcctttgcccactttttgatggggttgtttttttctcgtaaactttttaagctctttgtagattctggatggtagctctttgtcagatggatagattgcaaaaattttctcccattctgtaggttgcctgttcactctgatgatcgtttcttttgctgtgcagaagctctttagttcaattaaattccatttgtctattttggcttttgttgccattacttttggtgttttagtcatgaagtacttgccaatgcctatgtcctgaatgatattgcctaggttttcttctagggtttgtatggtgttaggtcttacatttaaatttttaatgcatcttgagttaatttttgtataaggtataaggaagtgatccagtttcagctttctacatatggctagccagttttcccaacaccatttatgaaataggaaatcatttcccatttcttgtttttgtcaggtttgtcaaacatcagatggttgtatgtgtgtgcattatttctgaggcctctgttctgttccattggtctatatatctgttttggtaccagtatcatgctgttttggttactgtagccttgtattatagtttgaagtcaggtagcctgatgcctccagctttgttctttttgcttaggattgtcttggcaatgcgggctcttttttggttccatatgaactttaaagtagttttgtccaattctgtgaagaaagtcaatggtagtttgatggggatggcattgaatctataaattaccttaggcagcatggccattttcacgatattgattcttcctatccatgagcatggaatgttcttccatttgtttgtgtcatcttttatttcgttgggcagtggttagtagttcttgaagaggtccttcacatcccttgtaagttggattcctaggtattttattctctttgaagtaattgtgaatgggggttcactcataatttggctctctgtttgtctattattgatgtataggaatgcttgtgatttttgccattgattttgtatcctgagactttcctgaaattgtttatcagcttaaggagattttgggctgagacgatggggttttctaaatatataatcatgttatctgcaaacagggacaatttgaattcctcttttcctaatttaataccatttatttctttctcttgacagattgccctggccagaacttccaacactatgttgaataggagtggtgagagagggcatccctgtcttgtgccagttttcaaagcaaatgcttccactttttgcccattcagtaagatattggtggtgggtttgtcatgaacagctcatattattttgaggtacattccctcaataccttgtttattgagagtttttagcatgaagggctgttgaattttgtcgaaggctttttctgaatctattgagataatcatgtggtttttgtcattggtcctgtttatgtcatggattatgtttattgatttgtgtatgttgaaccagcattgcatcccagggatgaagccatcttgatcgtggtggataagctttttgatgtgctgctggatttggtttgccagtattttattgaggattttcacatcgatgttcatcaggaatattggtctaaattctgttttttgttgttgttgtgtctctgccaggctttgatatcaggatgatgctgacttcattaaatgaattagggaggattccctctttttctattgattggaatagtttcagaaggaatggtaccagctcctctttgtacctttggtagaattcggctgtgaatccatctggtcctgggctttttttgatttgtaggctattaattattgcctcaatttcagaccctgttattggtctattcagacattcaacttctttctggtttagtcttggaagggtgtatgtgtccaggaatttgtccatttcttctagattttctagtttatttgcatagagtgtttatagtattctctgatggtagtttgtatttctgtgggattggtggtgatattccctttattatattttattgcatctatttgattcttctctcttttcttctttattagtcttgctctcagtctatgtagtttgtttatcttttttaaaaaaacagttcctggattcattgatttttttgaagggattttttgtgtctctatttccttcagttctgctctgatcttagttatttcttgccttctgctagcgtttgaatgtgtttgctcttgcttctctagttctttcattgtgatgttagggtgtcgattttagatctttcctgcattctcttgtgggcatttagtgctataaatttcccactacacactgctttaaatgtgtcccagagattctggtacgtagtgtctttgtccttactgggttcaaagaacatctttatttctgccttcatttcgttatttatctagtagtcattcaggagtaggctgttcagtttccatgtagttgtgcagttttgagtgagtttcttaatcctgagttctaatttgattgcactgtggtctgagagacagtttgttgtgatttctgttctttttcatttgccaaagagtgttttacttgcagttatgtggtcaattttggaataagtgcagtgtggtgctgagaagaatgtatattcttttgatttggagtggagagttatgcagatgtccattaggtctgcttggtccagagctgagttcaagtcctggatattcttatttaccttctgtctcgttgatctgtctagtattgacagtggggtgttaaagtctcccattattattgtgtgggagtctaaatctctttgcaggtctctaaggacttgctttattaacctgggtgctcctgaattgggtgcatatatatttagaatagttagttcttcttgttgaattgatccctttaccattatgtaatggccttctttgtctcttttgatctttgttggtttaaagtctgttttatcagagactaggattgtaacccctgctcagcaatggtagacgaccctccccccataacgctgtcgtgtcacaggttgatctcagactgctgagctagcagtgagcaaggctccatgggcgtggaaactgctgagccaggcaagggagggtatctcctggtctgtcggtggctaagaccttgggaaaagcacagtatttggtcaggagtgtaccatttctcactgtgctgcccaggctggagttccttagaaacaaatcagaaacaaatctctccctctctctctttctctctctctctctatatatatataaatatatatatatatgagttagttccaagatggccgaataggaacagctccggtctgcagctcccagggagatcagtgcaacacaatgagactctctttgtacattttgttcttcaagttagtagcattccttgaaccttgatgtacttgatatccttcatgggttttagaaatgtttggctaatatcttttaaaatgtacatttctcacctcttctgtgatgccatattacatatattacatctttttgctatgccattgtctctttaaatctatattttctctcattttcttcttgtttcactgtagtaattttttggtaattttctcattgtatcatttctttgtttctatttggtaattttcttctagtttaacaatcctctctttagatgtatccaatctgctttaaactcatcttttgagttctcaatttcagttatcatctttgcatttctattttatattttctttttgtagatttgagttatctgatgaaagatcctagcttaacatcaacttcttgaacatataattcatactttttattaaggcttgtctgcaaactccaatatctggatctattttttagccccaaattcttgatatttttgttaacagttgattgaattccaaatattatacgtggaaaatttcaggatgtttggatgatgtcagcttactccaaagaagactcatctcatcctctggctgatgattagtgtagaggcagttggttttaatacaattagaaataaagctttctctatgtttgttttcagacctctgtttgccttttctcacagactgtaactctccagggctctttacagagggtttgttgtgtgtattaaagctttttctccttgactgtctctgatattactgggagactgccaaatgcccactgtaactttttatttactttctgcttggcttctcatcctatgcctctatacaagtcaaggataagcagtaccttagggaaaagctggtgcagagcctcaaactcatatctctacacttcctatccttctaaattctttattcttcaagtcctggctgctttggtttaccgaaattctcatttttctatcttcaactccatgagattttcagaagttctgctggctgtatgcctaagcttaccattctctatcatctaacctctcaggtcagacttagagtcaacaaacacctcaagagaaaaaaatggcacatagaatttttttttttttttagacagtctccttttgttgcccaggctggagtgcagtggtgcgatccctgctcactgcaacctccaccttctaggttcaagagattcttctgcctcagctttcccgagtagctgggattacaggtgcatgccaccatgcccggctattttttttttttttttgtagagatggggtttcaccatgttggccaggctggtctcaaactcctgacctcagatgatccgcccgccttggcctcccaaagtgctgggattacaggtgtgagtcaccacgcccagcctcacatagatgttgaactcacctgaatacattttttccagaaccttacttccttgactaagttccttggaggttttctgatacctcgaaatgcttcctgtttttcagattttctggttcttaatagaagtgctggtttgatataatctcctctgtcatagctgaaagttaaaggtccatgaatcaacttttaaatttattttaatttaaatctcatgttctgtagaacagtgacatcgtaaattatagtgctattcgacttcattttcacaactattttgtaatgagtgtaataattcttgttcattttcatcacctgtagcacttccagcataatgtttgacacataggcatttaataagtagttgttgaagaaagtaactgaacacagtgctctcagctgcggtttcactttctgtggtttcagttacctgctataaactgcagtctgaaaacgttaaattgaaaatttcagaaataaacaacttataaattttaaattatgcacttagtagtataataaaatttcatgccattccatccttcctgccccagatatgctaaaaagaagctgtaaagtgcttcctttaagtgaaagggcggaaattcttaacttaaaaagaaaggaaaaataaatgtatgctgaggttgctaagatccatggtaacaatgagtcttctgtctatgaaagtgtgaagaaggaaaaagaaatccatgctagtttcgttgttgcacctcaaactgcaaaagttacaagccacagtgtataataaatgtttagttgaggtggaagaggcattaaatttgtgggcagaagacatgaacagaaacatgttccaaaagaatgacaacagggtttagcattatctgcgatttcaggcatgcactggggctcttgaaatgtatcccctgtaggcaatcagggagggcatactgtaagtaagtttgttaatgtactacaggtatatgattgatatgccatattagcaactctggacctttttacctgtctcagaagttattccttaatgctaggtcatccaggagacaaataaggacataagaaatcccattttctgaaataatttgatatttgatattttagaaatattaatgtttttattctgtaaaaaaaatcgaagaggtttttttgtgtattttaatacatactttaccattctctttggtttacgatacatgggaaaggacacaactatactttgtatgcttagaatttaaaacgtcttaatccagtcttgatatttcttaactagaaatttgaaagagaagtaactgtcaaccattttggatggcatgaggttataaagcttgggtcagtgttgagaatctacatttccataaaatgttatttatacagcaattaataatttgtctcatgagaattttatttgaactttctgaagaaggaaaagggaaaagagcatgatatcaatgaccattagtaactgtcaatgcttccccccaaatacctttttgtttgtttgctatctttgaaaaagctaatgacataaaactaaaataccttttagtttttaaaactggaagaaaataccttttctccaaatccaggaccacagagagaaatggctcactgttttctgtgagatttgaacatattttctgactcaaatattaattctgattaactgacttgctgctcttaggcctgagaattttaaggtcctcatgagtaggcaacacaacgattcctgttcttaccaagatgtaacaagatagttttcttctttttctttctttttttttaaattgttgttcccagagccatgcacattatcttttactgaaatggaaaagaataatttacttctgaaatgggattttgacaacagaccacacattttgcatggtgaatatattgagtttatttgtagaggagatacttatccagctgaattatatattactggatctatacttagaatgcaatgtgacagagggcagttaaaatatccaagatgtattccaagacaaaggtaagaagttttttttttttggtcagattattttttttggtcagattgttattcaacatttcagaaatgttatgttctataccactcatactttatggcaattgcaaagaaaaaataataatattttcttcattttttttacaccaaacaaacaactggaagtggtaatcaattcaacaggccttctgaattgtctgaagtgaaagcaacgtttgccatttgatatttgtgacactttggcaaatggaaaaataaaccaatttatacgtgcaatatttcaatgtgcaaaaattaacctatatgttctgtgataaggacaaaaatcacactttctcctacttctcaatataagttcaagcactactaataaaggttggaaaatgtggtatttattttcaggaccacatttttgtgtaacttttggaaattacatactaaagtgtttcctcatatgacagtttaaaaaatatatcctctgctacttacaggaaataatttaacaattttcttagagaaatgttaaaaaagtataataaaatgatgtaaaccattttgtaggatcacaattttaaccctttttgaagacactgtatataaaaaatggaaattatattttttgttcaactaagaatattaaaaatataagtagtggcaaagtgcatgtggtcctgttttaaaaaatgcaaacaatgaactgtatgaactacataaagtcagttttttagatgctttgaccactctagtaaaaaaatatttaaaagacacacaatagtgggaaaaatttttatttttatttctaattgtggtagcatcagggtggaaaaaattttatatgctatttaaatgttttggtacagtatgaatttctcacttttaagagaaaaaggtaaacacgtagaaaatatttaaaaaatcatgagtagtgtagtaaataatattgcatttttaaaagggaactggtggtattatttactaagtaagatcatttattcttattagtacttaataaaaacaatgactcattatatgaaaaattgaaaggctgagattgtaattaacacctgactgcaattgatgcttatttcaaaaatctctctttttcccctcaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcattatttataaatgaaaaccaataaatgtctaatttttagtttgtatgatttgatgtagaacttaatctcttttgtatgtcttccatctgttacaaattaatctacacatcatattttcatttcctaatgcccattgactagactatatagttgttttcaatatactgtatgtgcaaaaatttcacattcacattcgtcatcatctttattaatattaaggcttttgttacccttaattcaaagtttatgtcactattaaagggccaaacacactagagataagaaactatatgctgtattagaggatctgccttattaaaggcagaagagactgcccttcagactttctaaatgtaaaaaacttttaaaattaactgtaatatttgctacaacgttaataaccaaattgtttatgaggtggtgtactaccatatttgaacatgtgctcaaatattgttaaagagacacaattaaagaaagaatgacccttggaattttatttaattttatttatttatttatttatttatttatttatttatttagagacagagtcttgctctgtcgcccagcctagagtgcaatggcatgatcttggctcactgcaatttttgcctcccgggttcaagcaattctccttcctcagccttccaagtagctgggattacaggcgtgtaccaccacgcccgctacggtttttttttttttttgtatttttagtagagacaaggtttcaccatgttgaccaggctggcctcgaactcctgacctcatgtgatccacccgccttggcctcccaggactcttggcatttttacattttacactttcaagtctttttttatatcaaataatttttggaattatgcagactacaaaatctgaaataagagagtcctacaagcatcaaaaaatgagtgtcagtattatcaaggtctgttagagacatgaaacagcaacactgtcactttttcatttgaagtgagagttatacttctaattatttcagctcattcataagcatatgtaatagcactagtacccagatactaggaccccgattaggattggttgttggtattagaacgagttttcctttctagaaactactcagtttttctaactcaagatcttagtttctcattacgatgatattctcaaatgcccaatgtacaattctctactgctgggtatgaaatagcttcttttggaaatgatgccacagctgacctaactctgtggattaaataagtattaattcattcaatgttaaacatgtatatttcagaactgtccttgagttcatattcattattttaattaatctcctgtagtaggttcccacagtggatctcataaaaatggaaatttaattaaaattaaatatcaacagaaaagcattaatctttttaaataaatttcccaatctatcaattaaataacattattgagcacctgctatatcccagggaacatgctgggtagtacaggattcaaaatgattaaaattcacctcgttatttcaaagaactcacaaagtaaaaaactacttacttagtaaaagagataaacttgtactagtgattgcagactcaaaatgggtgatgattgtggcttatctagtgatatttctagtgaactggagatggcatgcactgtttaacctggacaactacttcgctcaaggtgaataattgtcatgggggaatattgtatccagtattgccatatgttctgatttgttaattgtgaaatgcactgatttttatatgttgcgaggagataaaaaattatttaggcagtgcagctcaaagtaaactccacatgctaaagaaataaaaattttgaaaagtgcaacagtggaagcatgtacgaagtaaagtggtggcacaaagtaggtagtatttaacctttttttttttttgtatgaatgtggtataggaagcttcttggaaaaaagttaaagtaaatctgaggtttacaaaactagaaaacacacttcaagtagaaggaatggcatttgcaaagtcaaagctcatactctatgctaggcattacaccgagcactgaaaataaaacaatgaataagacacagactgtttctgctcttgtggagcttgtctctcggagcggaagaaagatataagcaaatccttacaaaataaggcatggcagcaaagacaccatctttgtcagtaaacaccagatgatactgcctagtactgggtgtttaaaaagtcttcagtgaggaagtgatatataagtgacatataggctgagattggatgggagaaatgataagaattc

SEQ ID NO: 2381 - DNA, 3762 bp, Homo sapiens
  Genbank Accession No. M64590
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttcgaatctaccatggttcccatgggctggagcatattgctaggagggtacataatgccactttgattttgtcagaaggtctcaagcgagcagggcatcaactccagcatgacctgttctttgataccttgaagattcattgtggctgctcagtgaaggaggtcttgggcagggcggctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcatgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggttttttttttttttaatctgcatttattagtattctaataaaagcattttgatcgg

SEQ ID NO: 2382 - DNA, 497 bp, Homo sapiens
  Genbank Accession No. M64716
ttttttttttttttttgtccgacatcttgagacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatc

SEQ ID NO: 2383 - DNA, 2131 bp, Homo sapiens
  Genbank Accession No. M64929
ccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaataaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaag

SEQ ID NO: 2384 - DNA, 2798 bp, Homo sapiens
  Genbank Accession No. M65131
gccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacattgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaatccctaaaaactctctatactctctataacaatactttatcaagaactctggacaatggtattatttttaaaaatcatggtgatgtatttattagaatgtttcttataaatctctttcatttttatattaagaattaaactgtacctaaaaaaactctgactattcccatttctcagtttagcattacattgtcttgagcaccagaaaataaaatccatatattaattaaaacctatcttgaaaaaaaaaaaaaaaaaaaaaaaaaaaa

SEQ ID NO: 2385 - DNA, 4199 bp, Homo sapiens
  Genbank Accession No. M65134
cgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 2386 - DNA, 1266 bp, Homo sapiens
  Genbank Accession No. M65292
tgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttaatttttaagtattgttttactcctttttattcatacgtaaaattttggattaatttgtgaaaatgtaattataagctgagaccggtggctctcttcttaaaagcaccatattaaaacttggaaaactggaaaact

SEQ ID NO: 2387 - DNA, 15571 bp, Homo sapiens
  Genbank Accession No. M68516
aagcttcctcactccttggcacctggctccgacatcacattgacttttcccttcctgcttctaccatcacatcaccttcttctgactccaatctcctgcctctttcttgcaaggatccttgtgattgtaattaggacccagctggataatccatgacaatctcttcaagatccttaacttaatcacatctgcaaagtcccttttgtcatagaacgataacattcacaggttctgggtattaggacacggataacttcggggttccattactcacccataactggtatgcagtgctgatttccatcctgtaggtacggtttagggatctctaggtcaatgagataatggactcttgctcatgttacatggcataatgggaagaaagccaaacctagaaaaagagggactcaggttcccttgttagagcctcttcttactaactgtgggattaggggctgattccctgacctgctgtgttctgtcttctctccaattcaatgggaatgaactgtgagggcactgagcaaaaactaaggtctcaatacctagtagtagtgggacttgcctctggatacccagtagtgatcctgccgcctgtttctggatatcctacagtagcaatcccacctgtttctggatatcctacagtagtgatcctgcctgtttctggatatcctacagtagcaatcccgcctgtttctggatatcctacagtagtgatcctgcctgcttctggatacccagaagtgatcatgcctggttctagatacccagtagtgattgtgtttcctctagatacccagtaggtattgtgcttgcttctagagatgtagtagtagctggacttagctctagatacccagtgctcatctctagactgggctgagatcagtgtctcccttgaagggttattgtaaggatgaaaaaagataatgcgtttaaagcacttggtgtagtaggtggtctttttaaaagtgtgaataaatactagttcttattatttctgtggatatccaacagccacataattgggccccaaagccatgaagaaggaagaggaaatgtcttaaaggttgtcgatggacagtgtttgctgaacatcaaaatcactttccaggtattacctctgatttgctctaccaactccacaccccacctgcagccacataaccttccatgatcacggccatgcacaacacaccatgtcccccaggcaaggggaccttagaaacataaccaggcttgagacagcactctgcaccggtgtcttggaaatgctcttaagagtgtatggctgagttagggaaccaggatttcaaagtagaaagggagaatctacccaagcccatagaaatcctgaatccactcctttctcagcaacaagcactggcctgggagtcagccacttatgcaccaaccccactctgcccctaattaaatgcatgactttgaaaattcccctcattcttctgagccccaattcagtgattggtgcaatcacaggcttggctacagtgacccattcattgcaggcatggtgagactctcaatccctctcatttccactagaatctaactgttgggatctatgacccagtcagcatagcaggcctgtggggagctctcaggttcaagcatatgccccccctaatctacaagaaattagctgcagaaaaccaaggaatagaacctggaaaaagagagggtttgctagagctgtccctttccctgtctctggaatgccaacaatagggaggctctttggtcttgtctctcaggagtgcccatgccattccaggaaaatgatggcccagctggtggtgtaaggcttggggggcagcgagtgggcatcgtggtgaaagcctcgggatcagggagctgcgtctgcaggcaggcctgctggccggaaacctgccaggaaaggaaggggctgtctcggggcggggccagggaggggtggagacagggccggctgtggtcagtgacaaatgctggctgcaatccagccagccctctgccctttctgagcccgagggactgccacctccactgtgtgcacactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcataggtaagatggaaataattacaccctctggatggtgtgactgaagattaaatacagcgggtgctctcactcagcacatctggccatgtctgcagacacatttggttgccacaactggaaggggggtgggggttagtgacatctagaggccagcgatgctgctgatgatcccacaatgcccaggacaagatcacaaagcatcatcctgttcaaaaggtcaacaggatcaaggttgagagaccctgaaataaggccatggggacaaaatgtcggctggataggaggtgctcagtaagtggcagcttctgttgttttctgtgcctggagtcttggggctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaaggtaacggacgtgttcatggtgctgacggtgatgataagtgacagatgtagactcatctccaaacttgtcaggttatagacattaaatatgtgcaactttatgaatagcagtcatgtctcaatcaagtggttttaataaagaaataataggaagccagagctgagagacagggagggagttgttcaaggtcacctggcaagtgagctccggggcggggagagctcagctctgggtggccagcctggctttttccactgctcagtgtccagcttgcagtctaatgtctcgaattacagagaaggagactggtcagttcattcattcattcattctacaaaggtttatggagcatctctcctgactgcaagctcttgaaggtgagagcagcacaaatgagggtcccatggagagagaggccggaatgaaaaatgtcaatgacaaatgcatatataaaggcacatgtgtaattgaaagagctttgagagaaagagtcaagggactgttccagagaatagccatggaaggggaaaaggtccagtgtgataaggtattgcaaagaagtgacatttaagcaaaagcctgcagcctatgcagaagttggcctcagtgagaaaggttgggggagggttccagtagagagggaaggtatgcaaaggcccagagttaggacagaacttgctgtgtttgagaaactgggaaaagaagagtgagcctgggggtatcacgtgatccagggcagagcaggtccaggccaggtgcagccaggtcacagcagccctagtgggttagagcacaaatcaaagtttagcatttatctgaaacacaggagttggccatgagtttcttaggcgaggaagcgctgtgaccatatttatgattgaaggagattcttttatatgctgtatatagaaagcctttcagggcaaagaaaggaagctactggggtagccctgggggagatgaagggagcttccactgggggcagtaagaaagccagggaaaggcggcagctttaagacctgttttggagatagaacggacaagctttgctgatgggctggagtggaacaggaagtcaagattacttcttctgggaagttctgttcctgggtctttaggatctagaggaagctgtgactttgtctctcatctctgcctgggctccaagcctcacatccctttttgtaattagaagatattggacagaccgtcctcactaacacaattcccacagctgagtccagggtagaactgggcaggacttcactgcccaacacgggaaatatcagtcagcagatttgggtttcggggatggtggtgggccagcgggaagactgaccagggcctacccatcacatccccaccacctcccacctcaattcaccttggcctgagatgacaggtgaacatgactgatcctctctcttccctctgcagaaacactaaagccagggaccaggagaggggcagcccaaccaagctttcaaagcactcagtagaggctggtctgggggatgggaggctcccagggcttcacctgtctctgtcaaagccatgtatttccaccagaggcccaagagtgcgatggcaaaccctggatttgaaactaagaaacgtaaaacaagcactgaggactccactgcctcttgagtgacctctctgaccctctgtttcttctgcactgttaggataatgatactaactccatgttgttgtagagaagtataaatgagctaatacaggtgaaccgcctggggataccaggaggtgaggtcgaggaggaacgaggtatcactcctcagagccactcagagagaggctgtgcacgagtcagaggaacctggattttaattccggttccatcactcagtagctgaaacaagctattccacttcacttagcctcagtctattcaatctgtaaaatagagtgagtttacttttggaaaactctgtaaaatagagagcttacttttggtgaaggttaaacatagtaatatttatggagtgtctagtatgtctttaataattagtggttttactgaaaagtagagagagttggcccagagggagcaagatttctgggtctcaaacatgtagcccaggagagcctaagtgaacctggggccctctccaaacagatcctgggggagactcagtgcacacccggagaagcagctcctccccatcggatctctagtgcttggcagggggcggggtcttgagggggtgtccacaacacatggcagactgcagatgaagaaactgaggcccagagggggtgaggcttgcccagggtgacctagtagctgaatagatgggagaatggagccagggcctcactgagactctctggtcagctgcccctgggctgtatccaataaggaaactcccctgcttctgaagctgttctcgaaattatcagctcagtgtgaccctgtggggggttgagccacattgtttctttagaagcatctccatacatggctggttccaacccttggcaggagggaccatattgtgctgtaaaatagactcatttagagaagccggagattaaagcacccacctatgtccttcaaagctctccaggcaagtgccatggtgggaacaggtagggagtgtcagtggggggaagcccagactctgctcactcattatctgcagattagggctattgttggtggctactaagtcagggatttcaaaatcaggaagatgcagccaggaaaagaggaggcaggactctgcagaggaggcaggactctgcagagtcagagtgataaccgagtctgagtccaagctttgccagtgttagcaagcgactccatctctctgaacctcggattacccatctgtaaaatagagctagcagcaagatgtacctttttgggtggtgcagggctgaaggagttggcacagtgcctgaaagagggtgcgggcaatgcgcccaactgctgtggctgctgggtttggtgccaggttcgattctgcaggcagaaacttctacatgaggctccttctcggaaggagctcaggacacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccggcccgggtgctgtcaggctcacacgtgtgtgtgtgtgtgtgtgtgtgtgtgtgtgtgtgtgtgtgtaaagcatgtaccctatggtacagttgagaatatggaggcctcagatggggcttttgcagaaactgccatgcctactgctcacacttccatagcacgtgcccccaagcaccccatggtgtaggtgctgttattatcactatcttacagttatggagcagtggctcaaggtgtaactgatttgcccaaaatcacactacaaggacacagcagggctgagatttgaacccaggcagtggcttcagagcctgagctgtttcctactgcagagggaggaggcaagacttctacccgtagccagatggggaggcatgggcacaggaacggctcttgggtgaagtggagggaggaagaggaggactgaaggcgaaggccacgtcaggagtgatgggataccccacaaaggcctccctgagaagcgctagagacaaagatgagtgcctcctcatctggaagatgaaaagatgtctttgcctgcatgggctgccgtcacaaagtcccaggggctagggggcttcaacaacagaaatttctttctttacaactctggaagctggaagtctgagattaaggcaccagcaggatttgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagtatatgcattttgggggcacaattcagccagaacaggaggacggtggggatgtccacatgaagaggttcaggcagaattcctttaggaggggaagatgtctctctgtgggacaagggtggcatggagcagcccctgggggaaggagaaggggacagtttgcatactggtattctgcctaccccagggtggacactcactcagcgtttgctgaatgaacagggcaaggccagcagtgctgatggtcccaggcatgtagctggtctgagttcatagaaggaccacagcgccctgccatgtgccaaaccaggacaccagagtgaaggccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctaaatcttgtcctcgagccactgccaccctgtgtaaaccctcatgtccagtcttgggggtgccatcccttctctttaaagctgaatggaccaaacatacccattgagtgttgggtggggacatctctggaaagtcagcacctggaccagctccacccctctctgaggacaccttctttccctttcagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctggggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactcctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccaggatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcagtgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccataggaaggtcagagaagggtcattgaagacttcccaatgggaaaaaccattcatttccaggatccatactaacttctttctaaaatttaaatcaaaatattggaatgaaagtgcaaacagagaagttcacccagatatcaggtagcattcacagccagccacatttttcaccctcttcacttggagatttggtcttgagtaaaacgttagagaatcagagaacatcagggatccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccataaagatggtctccgctggctatctttactgtcttcactccttttatttgcagctgagaatttctaattctgacacaaaattctttttcatttttcccttttttcatctttagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgaggtgggttcagaagctcctatgcatctgcttcccaagatctattctgttctattctttctattctactctaccccatttcattccattccattccactcaactccactccactccactccactccagttcactctattcaattccactccactccagttcactctattcaattccactccactccactccagttcactctattcagttccactccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactctattctattctattccattccattctactctattctattccattccattgcagtcaactccactccactctctactattctattccactcctctcccctccactccattccattgcagtccactccactgcactccactcctttattctgttctgttctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctggtggcctggtgatgcctggtgtctcccctgcagatggtgcacaaagctgtggtggaggtggacgagtcgggaaccagagcagcggcagccacggggacaatcttcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattagcactgagatccagagaggctggatgacttgctcaagttcaccagcatggtagtggcaaagagaggtccagagtcctggcccttgatgcccagctcagtgccacaaagctcagtaggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtgtcagttgcaggtgccaatgactaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactattatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctgtggaggagagatgaccaggagcagaaacttcattcaggggcatctcaggcaccagctcccccatgagccagctaagttccctccctcccttcaccaagcaccatgtgtttcctcatgtgccaaatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccaaagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttacgaaggggccccttcgtggggtcatgcactcctgtgtgctttcccttgcatcatgccttgcctgtcttggcaaatatttctctggagtttacccagccagtccaaggtcacagggaagccctgtctgtgtctcacacagaaggtcaacgtccagcactgtccaaactttactcagcaaacagtcacaaagcagctcctgtgtgggggtcggggtggctcactgtggtctctgctgcatgtcacacattgaagcactgtgctggggtcatcgcaggctgtttaactcaattgtcacatgagcctgggtgcacaaaatggtagagcagctcagagagagatggacagacagcatgaacctctgaggagtcaggttttcttggatgaagggacactaagatggctttggagcgtgagaaggacctcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtcggtgccggcggttcagtgacagagatcctaaatgggaggccagtgttttgtctgatctctttcatcccaatttcagggtagtttggtcatccacgccacattccaagtgtcccctgggccctttctctccctcacccccctgtctgcacatgagtagatgcctccacgcagccctcccaggacgctcacctctatccacagatgcttctccaaaacccaccaggccctcccatggaacgagctcacctacagggtaaaatcaggtcacggtcacatataggcctgactactcccctcaggaccctcattcacagccactgtattaatttgctggggctgccaaaacaaagtgtcctcatctgggaggctgcagtagatttgctgaaattgatttgctagcgttgctgaaattgattcaagctt

SEQ ID NO: 2388 - DNA, 1949 bp, Homo sapiens
  Genbank Accession No. M68840
catagaagggtccttcccaccctttgccgtccccactcctgtgcctacgacccaggagcgtgtcagccaaatcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagcctgatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaaatattgacaagtttaaaggctgtgtcattgggccatgtttaagtgtactggatttaactacctttggcttaattccaatcattgttaaagtaaaaacaattcaaagaatcacctaattaatttcagtagatcaagctccatcttatttgtcagtgtagatcactcatgttaattgatagaataaagccttgtgatcatttctgaaattcacaagtaacgtgtatgtgctcatcagaac

SEQ ID NO: 2389 - DNA, 1121 bp, Homo sapiens
  Genbank Accession No. M68864
ggaattccctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctgcttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgctgaggagaggcggagggaaaatgccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgt

SEQ ID NO: 2390 - DNA, 1540 bp, Homo sapiens
  Genbank Accession No. M69013
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtccccagcgggagccccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgccccaggcccagggagacgggatggagacacggggcaggaccttccttccacggagcctgcgctgccgggcgggtggcgctgccgagtccgggccggggctctgccgcgggaggagattttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttct

SEQ ID NO: 2391 - DNA, 2491 bp, Homo sapiens
  Genbank Accession No. M69177
ctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcaagtaaagttccatgaagacaaatagtgtggagtgaggcgggggagcatgaagataaatccaactctgactgtaaaatacaatggtatctctttctccgttgtggcccctgcttagtgtcccttacctggcttagcgttctgtttcaccagtttccaagtttattgccctcaaatctttagaatagttaaattggcttgtttaaggttcttgctgccccacaacacaccttgcccatgcacaggatgaattttttcctaccattatggctttgtgcttgttcttcctcttacctgtatagcctcacttccctagttctttgcattcgtccttaggtactgtattgttacagctgaaagacagtaaagaccatttagtcctcaccttctgttttagagttgagcaaactgaagcccacagaggtggaacttaattacctaagagccacaataagccactggtatctgggggactagaacacaaataattgcttttcccacctctttggatgttttccccaattatcctccttcactccctgtcatagttaccgatggtgtcccgttgtgtgggtttactctgtgctaagttgtcttacacttctcaaatgctactcagtatatagccttaactcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccat

SEQ ID NO: 2392 - DNA, 4466 bp, Homo sapiens
  Genbank Accession No. M72885
tctagatctctagtctataagaccagaggagacagtggctacacatataaatttcagtgtcttccactgatatccgagtgataagcaacttcctttctaaaattatgaaagtaactaagggtctaaaaaaaatttctagtgcggtagtcttaaaactacaaatagttttgtcatatctcctatgatgactccctcccttcagctgcctggagcccaggggtgggcagtgactttgtgtaggcagcaagcagccggtaacaaaataataattattattgttattattatattataataattgtaacaataacaattattattgaagctcatttacaactaaccatccaaaagacctctttcccctgtgtcttcaatccccaaggcagaggggtagggacagttctatccctcctctgcacttaacccttgaaacacatgcacccctttgtgactttaccctctgcagatggctctgaatgtcttaatgtctgagagaaagggatttagaaagcaaaatataaaaattttaaactagtccttcctaccttcctagaagtggcaagagttaaatgttgagatagactcaagggtaggatgactatttcagtttgcctggaagtgtttcagtttgcctggaagtatctcagttttagtgctcagttttagcaggagtcctgcatttcagagaacccctcaaccctgagcaaaataagatggttggtcaccctatggcttggtttgaccatcatcgctataacctgtatcttacctgcatgcatgacacaacacagtgctttacttccctaaaaatgacatcagccccactaaaatatatgtttagtttccaagccctacctagtcaccttctaccctaggagccaggttctcttttcccacccagacagaggagctgcactcagaaattcctagacatgagttaacactggattccttagccttctactcccatcatctcctgctcagccccagctaccacctaaactaggaagatcaagtctaccagtgacctccgtccatggcacttgctgcccctcctctgtccagctcttaccaatatagctgctggaacctggaggtcaaagtcaaattatcaaaaaaaggaactgagctggtgatgtgcactaacacagcaaatcacaggaaaggggaacccaggtaaattacagccttctgacctaggaagacgtgtggtttgcgtctctgagttacagaaacacaggaaatgcttactggaccagtcaatttcagaattttgggtcccaagctaggctgactcaccttcagaatggaaaccacgtgacagcccttatatcagggcacacatcacatgctcttccagaagtcaatgggtttggaaccctcacagatattgggaaagctcactaatcatttctgccagttatcagaggttgctctgaaactataaggaagattcaaagaaaatgccaagactgatattaaacttggcaggaacccttgttacagaattttcctgcctgacaaggttaaaagaacaataagcaggaaacacagtcctccaggaataatcaattctatttggcccctggtcaccttcactcagactaaattctaaaacatagaatttcaaataagctatttagataaccttgaccattctccacacacaagcccttgcctgaactattaatagtcaaggcaaagggtagttgttattgctgcctttttaaactgaatcatctgagaaattgcttcagacccccaaagaaagattactgttaacaattcaaaaactaaaatatttgatccctgagacagccttttcccccgacccgcccttcagggctcagtccgaccgactgcaaaggctgttgcaagattgcatcactgacctttgcaattttctggccagtttgattccccttctttcccctgccccctccctttctctgcttaaaggcctttggccaatttgcctctccttttccccaagtttgctaaccctttggccaatttgcctctctttttccccaagtttgctaactctagcatatccataaccaaagccaaactagaacgctccctcagccccaggtgattacagctaaccctggtcaaaatcaatcctacatcttcacacgtccaagagtactcacactctggattcttacctaagctgtctactacacgcccttctgcccacaaactgcttcaaagctgaagttgagctggagcagtgaagttgtacccccaaacccaggagggtggcagagaattattgaggagagcatgaaatacttccattctaaaatggcaagatgaacttctaccaacagccccttccatacttgaccccctacccccaagctcccaactccacttctcaagtggaagtgagaacaatttgaatttgaaggctcttccctgatacacggaagtacataaggaaacagctcgcaggcaaagagactaatctctctctctctctctctctctctctctctctctctctcacacacacacacacacacacacacacacacacctctgtgcataaaagcaccatcaatgaatagttttctatcaactgactctagttatacatgcatgtacctctaaataaaaccaaccaggcaggaaagaaacaatattagcacatattgctttatccaagcgtaacctgttctgtcctgttacccagatccttcccccttgccttctcctctctgatccattgccacacacgtgggaaggtgacaacccttccgaataaaaatgaaagctttcttctttagatggaacccccaaattccctcattatttataatgtcaggctgtcctggacaagggaagctgtgcacccgctgacaccagtaagaaggttgccgccatgtcagagatgtccgcggacacctccctgggctccgggtcctcccctgcgctcgcctggagtgggaccttcgcgtgcacactggccttcccacgcgccccgctgcgatggcacccgcgccgggccccctagctcacacagtcggagcgtgctcagcgcgtggccacctcttgccaggtcccagccgggttccaccccctccttttcccctcctcttcttcctccccctccgagttcccctggctctgaccgcgctggcctgggcccgagagcccaggaggcgtgtctcagagaaaagatataagcggcccccggacgctaaagcggtgccagcggcggagtctccaactgggagagctgcagctgccgagaggaggagaacgctgaggtcggtcggaccaacggacgcgctgaccgctgccaactgcagctcgcgctgcctcctgctcgcgccgtgccactaaggtagtccgcctttctatgagccctccccaagattagctgggtgcggggtggtgggagccgttctttggtggctgaagcccctctcctgctgctcctcctgcaggtcattcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagagaggaagggagagacagagggggcgcgcgcacaggagcctgactccgctgggagagtgcaggagcacgtgctgttttttatttggacttaacttcagagaaaccgctgacatctagaactgacctaccacaagcagccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaactttttataccatatctcatgtaattcctgagaggtgtggtgtcctggggtgggaagcagggagggtgagcaggtgggcgatggtgatgggttcttacctgagcactgcagagggagcagcttcctgagggtcagacacttgcttcacacctaggaactgtgtaataagttactacatgcatataagtctgttgaggacttgtttttccttcttgttaggggtgggaagagagaaaattttataacttccgtgagatttagcattttaacatcaaaaggtagatc

SEQ ID NO: 2393 - DNA, 6128 bp, Homo sapiens
  Genbank Accession No. M74587
ggggagcttggcagagccctaggatgaactgtgttttgttttgttttgttttgttgcaggttggagcctttttcctgcagaaagagaagcaattccgggcttttccacagataacctgctagggctcgcagagacctggattctaaccccatctcgcctttcctcacctggggcattgttttctgcatttgagaactgctgggtgggctggtgttacccaggatttttaaatttttgcaggagacgctttgcaggagatctctagggcttttttctgtgtcaattaaagagcctggccagctggacctgggctgtctttttgacaaaaacaaacgtcatccccctcccagctgagcacttgttagaactggactttaactgagggcctgaaccccctaacaacgggacaaacagtatgaaatcaaaaccgtttaccctcctcccaccagcggtttgcgtagggccttgggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcaggtaccacagtcccgcccctgctccagcacctcctgccgcccgcccccgcccggcacctcccgcccccactcccctaactactgggtggggctgcagccgggcaggggcttgtccacaactagagcttgaaaccagagcacgtagttggggaaggagcttgggtcacccagtggagcccgctcattgcacggtcttggcaggacgtgccctgggagaagaaggaagatgttccagggcacacatagcttagtggagactcaaggaggaagctcccacttggccctcgtagcccagggatctttagagacccagacagcaagagtagagggaggcggtggggctgcctccgcagttgggatgccaccctgggtcccccaccagtctccttgccagcacgtgggcagccccagtggctggagcatccgggaaggcctaagaagggaatccctcctgctggcctccccaggaggtgtttggaatgtcctttgtaatatacgtcctggatacagtatgtgcttcccagatgtttacagaacataatgtgagagttgaggctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctctcgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagtaaaatccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataaaatgtactgttttaactattttgaagcataggtttctgtggcattaagtaacaataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacaggtaggtggccttgccagtgtgcgtcgtcagggtgaaagggactactgccctacattcctgccaagccacggtcattcatgtcaaagaaggtccactccaaagtagacaccagaagtggttgtattgagccagatccacccctctgggaacctggaacagctaggtgaagaaagcctattgaacaggtcaatatgtcaccaccagaggtggaaaacctgcgctggaccaggggccctggggctaagcctgagctccatcactcagcaagccaatagctatggaagactttcctaggccccctaacgcttggatcttgggttcctcacctatacaagagaggaagggaacaaacttaacttagaaaagcaagtatctatttggacagctcttaacacttttttctccttgaactgtctaataaaacacaacaacatttttgtggcttgccagataataaatgagatcaaacagaccaagatttcatattgaggagtgctttaggtctcagtgaagtacaggttctgtagattttattgggagaaactgaggactaggccctgcttcacgggcaatgaacagtggggcacacacgagacatgttccctctgggatgggctcccctgacatcaggctatgaagcagacagctgtacacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttatctctgtggatgtttatttagtgatattatctttttgaaatccctttgtccttcaccctcaccttccttatgcattttgtgcttttgtgataccaagatggtgttttgggtctgcagagccccttgtcctaactaccctagatcttgccccggctgccccagggtttccacttcccagtggcattgggaccttcctcctctgcctggccaggctgggcattcctgtgtcccacctctccattagtccccatcctccccagggtcctcagcctcttcctcttggtttggtttgtcccttccgttcaacttataaataggaacagggtttctttcctcttaaacacaagacag

SEQ ID NO: 2394 - DNA, 2155 bp, Homo sapiens
  Genbank Accession No. M74715
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacttggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatattttt

SEQ ID NO: 2395 - DNA, 2500 bp, Homo sapiens
  Genbank Accession No. M74719
cggggggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggc

SEQ ID NO: 2396 - DNA, 1728 bp, Homo sapiens
  Genbank Accession No. M75106
agagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaaacagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggacggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaaattgtaaaagtctagttacctactttttctttgattttcgacgtttgactagccatctcaagcaactttcgacgtttgactagccatctcaagcaagtttaatcaaagatcatctcacgctgatcattggatcctactcaacaaaaggaagggtggtcagaagtacattaaagatttctgctccaaattttcaataaatttcttcttctcctttaaaaaaaaaaaaaaaaaaa

SEQ ID NO: 2397 - DNA, 714 bp, Homo sapiens
  Genbank Accession No. M76665
aacccctgacagctaagtggttgatgtctccaggccttccatcatgtagactgtcctagtcagataaccctactcttcccttgtcattctatagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggttctttaaaccataaactgtacaatg

SEQ ID NO: 2398 - DNA, 4990 bp, Homo sapiens
  Genbank Accession No. M77232
  unsure (1)..(4990): n = a or c or g or t
ggtaccgtcagatgcaaagtgcctgggacagaagtggggctccgctggcgcccagctccaaaacccaggcagcgtggaaaagactagacagggaaggggttagccctcagaattacacgcgggtttgccttaccagactaccaccactggcacaacctcagacccacacccaaccgactttacctcccaggccctgattaatctcgcccggaagtaccgcccacccatgctcacttccgctatcccgtacttctgctcatctcgcgagaactgaaagcgcctatgtgacctgcgctaagcggaagttggccctcttttccgtggcgcctcggaggcgttcagctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtgttaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtcacactgttgcccaggctggtcttgaacccttgagctcaagtgatgctcccactttggcttcccaaagtgctgggattatgggcgtgagcaccacacccagcccaaaattattttttggcttacaaaagaagttgctttaaacttctgtttcatctgtaggatatggataacaatagttaagagttgtgagaattagaagttagagaccttactcagaatactagggagcaggtgctagggattttggagctttaccttttaagaacttttgtccatatagtagacaacatactcaccagtgaggacctcaaatagcaatatttctgtggtgaaatttggggatatttatgttaaataaacagcatgtcagtcaaggttgggttttcctgacaaaatttgaaagaatttctctggattttggttttcaggactggtgtgacttaacatacatggcatagatagtatacgtctgttaagtcagtaattacacttacttgagcacaggtactgttcaaggtgctgagaatacagtatagacaaattcctacccttatgaagctgatgttgcaaaaaaaaaaaaaaagcaattgacaaataggtggcagttgcccataaccatagccctggaaataatccgtataatacaagcgtggtctggttgatgggtatttttagatggttcttatgtctatagtaggaggcttaacattttagcagaatctgaacatctgagcatttagcctaaggcagttaactccctacaaagtgtccatgaaacaaatacatctgaaaaggcctatnctccaatgcagatctgtaatccatgagcagttttggagtacagatcagattaatgaagatactttaacaacatcccacctaatctgatgttaatagttaacgttacccctgaattggcaggaattgtcaaaggaaatagagatgcaagcttacatcaaatttaaaagtatggcaggatgattatgtagataatgtgttaagtggttttcacagacaaattaactatgcacagttatatattaacataatgccactgtattttagtaaaactggaaggtagtaaaagttagcctggttatttttcaggacttggtttcccttatatttttataatatttaaccaatcttctagatttctgtggagggggaaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggttagtctaagatgatttgagggggtgggaggagttcgacctggctttggatttgcgtctttaacccagaaaggccttaactgtttgctgttttgttttgtttaggaggctaaggagaagcgccaggaacaaattgcgaagagacgcagactttcctctctgcgagcttctacttctaagtctgaatccagtcagaaataagattttttgagtaacaaataaataagatcagactctgatctctgttgactttycattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacacactgaaaaggaaatgactaaaaacattcttggatcatgtaaaaatgcacaaagtatgtacttttttctaacagttctatgctgactagcctattgtgacaatatcaggatctttagaaggtggcacattaggctttaaggttgaagtaatgcaagctctttgttggcattactgtaataatagctttacaaagcagagttctaaa

SEQ ID NO: 2399 - DNA, 2691 bp, Homo sapiens
  Genbank Accession No. M77349
gcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 2400 - DNA, 1792 bp, Homo sapiens
  Genbank Accession No. M77836
ctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcacggtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatct

SEQ ID NO: 2401 - DNA, 3587 bp, Homo sapiens
  Genbank Accession No. M79463
ctaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagcactgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggaacccatggagaccgccgagccacagtcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtgttctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaa

SEQ ID NO: 2402 - DNA, 4403 bp, Homo sapiens
  Genbank Accession No. M80482
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatccc

SEQ ID NO: 2403 - DNA, 3397 bp, Homo sapiens
  Genbank Accession No. M81182
atggcggccttcagcaagtacttgacggcgcggaactcctcgctggctggtgccgcgttcctgctgctctgcctgctccacaagcggcgccgcgccctcggcctgcacggtaagaaaagtggaaaaccaccattacagaacaatgagaaagaggggaaaaaagagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaaaactcagatatcctataaaaaaaaaaggaat

SEQ ID NO: 2404 - DNA, 614 bp, Homo sapiens
  Genbank Accession No. M81349
tatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattga

SEQ ID NO: 2405 - DNA, 510 bp, Homo sapiens
  Genbank Accession No. M81757
ctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgtaaaaaaaaaaaaa

SEQ ID NO: 2406 - DNA, 3610 bp, Homo sapiens
  Genbank Accession No. M83216
cctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacgccgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacgtgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggatcctgtttctaaagaaacccatgctgtgaaatagagacttttctactgatcatcataactctgtatctgagcagtgataccaaccacatctgaagtcaacagaagatccaagtttaaaattgctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaagaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcatcatcactataatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtcc

SEQ ID NO: 2407 - DNA, 1543 bp, Homo sapiens
  Genbank Accession No. M83652
attccaggagcctatcaacccagataaagcgggacctcctctctggtagaggtgcagggggcagtactcaacatgatcacagagggagcgcaggcccctcgactgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgcgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttccgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcg

SEQ ID NO: 2408 - DNA, 2106 bp, Homo sapiens
  Genbank Accession No. M83772
ctttgcaactactggccagtgggaggttaccactgaaagggatggtaaaaaagaaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaaaagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgaccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtattgggctttgtccagtcccttggggctgccattcccacagttgacctccagtcccgctgggcagcacaagtaataaagggaacttgtactttgggccctttctatgggaagacattgatgaatgatattattgagaaaatggagaaaaagcgggcaaatgggtttggcaaaagcgagaccatacagacagattacattgtttatatggatgaactctcctccttcattggggcaaccaacatcccaatgctgttcctcacaggtcccaaattggccatggagttatttgggccctgtagtccctaccagtttaggctggtgggcccaggcagctggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaataccagtgttatttctaggctctgaaatagcactttaagaatcatgtcatgatcttaagagagcactaatcatttctgtttgagttccactcaacacttcaaaatcagaactatgttctttatatctaacttaaatcatttcctgaaacattttgacatgattcctttttccttttaaacaatgtatgaaagatgtattttaaatctaaataaagagcaaattaagcaga

SEQ ID NO: 2409 - DNA, 2834 bp, Homo sapiens
  Genbank Accession No. M86400
gcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgattttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattctttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 2410 - DNA, 1560 bp, Homo sapiens
  Genbank Accession No. M86667
ccctgagtcactgcctgcgcacgtccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagt

SEQ ID NO: 2411 - DNA, 2113 bp, Homo sapiens
  Genbank Accession No. M86752
gtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 2412 - DNA, 2125 bp, Homo sapiens
  Genbank Accession No. M86826
ggcacagcagacgtaccctccctcgctgcctgcctgcggcctgccctgcatgcaggatggccctgaggaaaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgacggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaaaaaaaaaaaaaaaaaaaaaaaaaaaaaaaaaaaaaaaaaaaaaaaaaaaaaaaaaaaaaaaaaaaaaaa

SEQ ID NO: 2413 - DNA, 200 bp, Homo sapiens
  Genbank Accession No. M86873
ttctttaaataaagaaaaatacttattggatttcctgcttcgttctgcagggcattccaatatcacagtaaagagcaacaatgtgtgataatggctgaaaacaagaagtcctccataatcattaggatgagagatgtagttttatttgaaaagtaaagtgagtacattttcttcctcctcctcctactgtcctccccatc

SEQ ID NO: 2414 - DNA, 1446 bp, Homo sapiens
  Genbank Accession No. M87339
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgatatatctggatggggggttttgtaaataatgaagttgtaataaaaataaaatgaccaaaagcaccg

SEQ ID NO: 2415 - DNA, 3634 bp, Homo sapiens
  Genbank Accession No. M88163
caagactggaagcagagagagagagcaagagtgagagagagcgagcgagcgtagtcaggagatggtgttgtattccaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacggtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagaaaaaaaaaa

SEQ ID NO: 2416 - DNA, 2030 bp, Homo sapiens
  Genbank Accession No. M88338
ccgcgacggccgccgccgtgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccggtactcccaggccggcttaccccaactaccccgccccagccaccctccttaccccagcaaaggtcaggt

SEQ ID NO: 2417 - DNA, 1967 bp, Homo sapiens
  Genbank Accession No. M88468
caaaacaaaaggtagtggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggacggccccctgtctctcagggccaggcctctccctcctccaggaagccttcccctaccccttgtcgcccctccctcccagagcacctgctgtctgggtggctcactcagcacttggcccttctacctagcgggatggggctcccccaggggctgtcccggaggcggtgggcctggttaaataaggcagtgtggccttggtttatatgcactttcttccgatctgtacctgagaggtttgtggaaaagatggcaaatggggaataaaaagattttgtgtcaac

SEQ ID NO: 2418 - DNA, 1539 bp, Homo sapiens
  Genbank Accession No. M91083
gaattcggggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgcccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagc

SEQ ID NO: 2419 - DNA, 822 bp, Homo sapiens
  Genbank Accession No. M91432
atatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcat

SEQ ID NO: 2420 - DNA, 1746 bp, Homo sapiens
  Genbank Accession No. M92843
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 2421 - DNA, 672 bp, Homo sapiens
  Genbank Accession No. M93036
aatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttgacatttcaaatttcttcttctttttcttttcttttttttttttttttgaga

SEQ ID NO: 2422 - DNA, 1164 bp, Homo sapiens
  Genbank Accession No. M93143
tctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacagtgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtg

SEQ ID NO: 2423 - DNA, 1423 bp, Homo sapiens
  Genbank Accession No. M93405
ctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttaaaaaaaa

SEQ ID NO: 2424 - DNA, 1496 bp, Homo sapiens
  Genbank Accession No. M94065
aaattaccgtggagacacctgcaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagcctggcatgcgtgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgg

SEQ ID NO: 2425 - DNA, 3308 bp, Homo sapiens
  Genbank Accession No. M94250
ggcggccgcgctcgtcggggccgggggcggggccgatccctccggcttcccgcttcccgcggagaacaacaatgaaagtgaaagaggggtggggcgggggcgagcccgggttctgtggcccatttgccctgtggccttgagcaagcccctcccccaggcctcgggggctctcccggtttgggggaaccgggcgaggcaatgccacaggcccagggttagagggggtgggcacttgcagctgccgatgtggctggatctggaacttctcggagacggctcctgtcagcgccaagtttcaccaaatccaggcctgcccctcctcccccaggacccccactcgcagtccctcaagcctgtgctcccggaaaggcactgggcgaccgcacccgtggctttctctgggcgaccgggtcccagactccccccagcacagcagagcgcttccctgcccaccccggaaaccgccccaggtggccgcgccccctccccagcagccagcagggcgccagggctgagccggccgtggaggggagcgggtcccgcggttatacaggcgccggggctccgcggcaggcaagagaagctgaggcctgagaacggcccaaaccttggcgtacggcaggggacgacctgggatgggggcagcgggcggcggcgcagggagtgggccgggggccggtgtgcgcgggcgggacggggcccggggtcgggagacaccgcttggaagatggggccgggagaggcgccgtcgcagcgcagagggcaccggcggggagacgcgaggacgcggggcccgggaacacggacgccggagtagaagcgcggggggccgggctggagcgggggcggggacgcgggggtcgggggcggtgcgggtttgaggggagggggcgggcgggtccttccctgggggggtggggagagggggcgggggcccatgtgaccggctcagaccgttctggagacaaaaggggccgcggcggccggagcgggacgggcccggcgcgggagggagcgaagcagcgcgggcagcgagcgagtgagcgcgcggcgggcccctggtccgccggcccgcggccgatctaggggctgggggctggaggcggggtgggggtctgagctgcgtcctgggctcgaggcgtcccccgggggagtcgcctcttagcggtgcgtccgggctagcggcgaggggccgccccaagtcttcccaccgccgccaccttagcagcccgacttggggcctggaaagtggagcacgcggaggtgggagggccctgcacgcggccccggtgggaaaggggacgggccagggattcagactcgggctctcccctcaggatgcagcaccgaggcttcctcctcctcaccctcctcgccctactggcgctcacctccgcggtcgccaaaaagaaaggtgatgggggatgatcgaaggagggctggggacgggcaggcaggcccctccacttctggctggccgcctggttcctagcctggaacccaggaaggcggctcccgagggagtctccccgtgccccagtcctgaactctgttcctcgcgcgtgtagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggaggtaggcgggcgcagtcagagggcagagacgggggcacagcctcgccgaagcctgggcggacccttggcggagggcggggccgcgggcgcgcagcgctgacctgggccgctctctcgccagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgcccccccccccccgcctgtgaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagagtcctggaacggcttgcctttggtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcaggtgaggaggctgaggatgcccagggctgctgtgaccaggactaggactggaaacttgaaggttttctgatcccaagtggaaataggaagctggggatgtcccatgtccacatcacaatggctgccccatcccctgcttccgagtcagctgattggaaaccactaggggcagatcttctccttccctgatgcccgggtgtttgtggagccggcggtctgcaatgggtcagcctaactgctgatatggtattaatatttctttcttgttttacagccaagaaagggaagggaaaggactagacgccaagcctggatgccaaggagcccctggtgtcacatggggcctggccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatataaagccccttcccaaggagtttgctgtggaaatgtgtttgggagtgggaaggtggggagaaagaccaggctgtagggactggtgggtttcagggggcttggtggtgggtgctctccagagctcatggaaaaagcagaacaattacaacatttcttccagggcccctgaaaggtgctccccatcaagtcacctaagcctttcggtcctcatctccctca

SEQ ID NO: 2426 - DNA, 1221 bp, Homo sapiens
  Genbank Accession No. M94345
cgcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccctttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccc

SEQ ID NO: 2427 - DNA, 4270 bp, Homo sapiens
  Genbank Accession No. M94362
agagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagagcctgaagctgtcccccagcccatcttcgcgcgtcaccgtctcacgagccacctcgagcagcagcggcagcttgtccgccaccgggcgcctgggccgcagtaagcggaagcgctggaggtggaggagcccttggcagcggcccaagcgtcctgggcacgggcacgggtggcagcggtggcttccacctggcccagcaggcctcggcctcgggcagcgtcacatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgggccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactattttttatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggcaagcctgcattctggctgcccagcttcggacagcgggaactcctcaggcagccacgcagcgggtgtgggccagcatggggatggcgtggccccaggggggttttcactccgctgcctgggcttccagattcccgttctggcagcgaccggccgggtttctcggaccgttgactttatttgggggagttttcccgcagttcagttcctgactgtgcaaggccaacagggcaggggaggggaagacctggggaaggaagaatgaggacacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatcacatgcgtctatcatactgtgtctttatctgtgatttttctcgctgaaacatgtttctcagacagccaaggccacctgactcctatcacgacgcacccaagcccctcagtccagcttcccaatgcctggcacccccttcggcaatagctcaccgtttacaccctccctcatagatacacagaagttatttttttaatggatatttatttttttacattggtcagtacacaggtcagggagctcacgccagggccttgaggacaggctgaccctcctccccggggtggcgtggggctggggcacccccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagcccaggccgggaaggagccagcggccgacaaagcagaaacaccgctgctccacgtagcccctgctggctgtccttgctctcagaagtcccggtcccatgtagatagagcccggcggatcttaccaaagcatttcctcctggaggctacgccgcttggtgctcccagtgaggcggctggtagggagctttgcctgccccggggataccctctaccagccgctggaagtgggaatgctggcgacagactgtgtctgtttcccaccttcatagcaggaatcacccggacccgactggctgggcttcgtgctagcgagggttttctgggggtgggtcttggtgatcttgtcctatggggatctctgcagtggtctcagccacatcctagtatattttggctctggaggagcaaagctgtatcctggagttggtctgtgatttgccgacagacttgcaggctgggctcagcaaagtcccccccaaaacccgcaggtcctcatgtccagacgctgccagtcctgtcctgaaaacagcacgccccaggcccacagaaccccccaccctacatttgccttgggtggagctgggggtggtcctaggactgcgggtgcccttagctgaagggggcccgcagaagcgtgagctgggccgcctgtgggtcattggaggttcattgagaattgagtcctttggaaagactaagaaaatcaaatttttaaaagttatttatggcctgggaaacaatttgcatttgtccccaaatacgcttagctgtgtgccgcttagaacgatgagaaaccatccctctgtgtaagcccgtgccgtgtgactcgaagcctagcgccctccctgcgaagcatcagacgccacccagccctgggggaggcccacgcctgctggaccaacgcgggttctggggtgcacagcgccaggttaacgctgaagcctgccccgctgagcccaagagccgggaggcctgcgggctgacccagaatccgatcatgcacctgtcctcatgccagcggctttggctggggttggtctgaagcctgcacgcggcagttctttgttaaagatctgagggactcgtcagtcctagcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctagcgtgttcttttttttttccaatgatttgtaatatacattttatgactggaaacttttttgtacaacactccaataaa

SEQ ID NO: 2428 - DNA, 2043 bp, Homo sapiens
  Genbank Accession No. M94891
ggacagcacagctgacagccgtactcaggaagcttctggatcctaggcttatctccacagaggagaacacacaagcagcagagaccatggggcccctctcagcccctccctgcacacacctcatcacttggaaggggctcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacgtctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataagaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaaaaaaaaaaaaaaaaa

SEQ ID NO: 2429 - DNA, 3865 bp, Homo sapiens
  Genbank Accession No. M95585
tttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttcttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaagaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaaaaa

SEQ ID NO: 2430 - DNA, 10024 bp, Homo sapiens
  Genbank Accession No. M95623
aatcatgattgttaattatgttcatgattacaggcgcggtggctcacgcctgtactcccagcactttgggaggccgaggtgggcgaatcacctgaggtcaggagttcaagacctgcctgactaacatggagaaacctcatctctaccaaaaatacaaaattagccgggtgtggtggtgcgtgcctgtaatcccagctactcggggggctgaggcaggagaattgcttgaacccgggaggcggaggttgcagtgagctgagatcgtgccattgcattccagcctgggcaacaagagcgaaactccgtctcaaaaaaaaaaaaaaattatgttcatgggaaagcacttttcctaacaagcccttttctcactacatgtaggtttgtgctcccacttcagttacttgtctttaggcatgacctttaatctctctgaaccagtttcctcattttaagaattgaaatgctggctgggccagtcgtcacgcctgtaatcccagcactttgggaggccaaggcgagatgactgcttgagtccaggagttcgagactagcctgggcaacatagtgaggccacctccccgctgtctctataaaaaaatctagaaattagtcccacgtggtgatgtgcgcctgtagtcccagctgcttgggaggctgaggtggggggatcgctgaagccgggaggtcaaggctgcagtgacccgtggtcatgccgctgcactctagtctggggacacagtgagaccccgtatcaaaaagaaaaatgctgcctatttcaaggttgtagcaaagctaagtttgaacagagcaaaggaagcgccatagaagctgcactacttgctcatgtcacagctggggaatggggaggtcgaatggggaggtccactgtcgcaatgttccaattcccgcccagagggagggacctccccttcgagggagggcgccggaagtgacgcgaggctctgcggagaccaggagtcagactgtaggacgacctcgggtcccacgtgtccccggtactcgccggccggagcctccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggtcagaacggctatcttttttttttttttttttttttttttggtccgagtagcttttaaagggccagtagctcggttgccctccggaaggaatggggaaatcagagagcggtgatactgggttaagagtggaaggattgtttggaacggaactccggtccctgcgggcatctgggtgggattcccatcaggcctgggatgcacggctctagatttagtgacccagaccaagaacgttcgtctacacagacggggtcctttcattcgaggctgggctgaggcggatgcagatacggcccctttgggaagacacgttccacttttgattcataggagagagtatcagccaagcctccgaactgcacacaaacgtcttagaagtgcgccttctttttgtgttatagtggtctcccagccacagccaacgctccaagtccccagctgtgacacacctactgaattactaccgtgggtgggaggccgccgtgggcctttccattacgagcctgcttgccgagccctgggcttgtgcacagacaaactgcagagctggtggaggccactgccaggccgagataagaaagagatggggagctgctaatctccccctgtccagcctgttggtgagggctgggatctttgctcttgcagtcattccagagccctggactaggagtaggaagatctgaattgtggccccaactctctttcggttattagctctgtgaccctaggcaagtcacctcatcccttgatgccacccgttgcttctgtaacatggtcccaaaggtgcctgtcttgtccacctgataggatttttgagacgacaacaatatgcaaaagcaatagcttcaacatagaagtgctcagtgttttattttttaatgaaacggtttgacttggatatgctgtgcacattcaatgaacttaaggaattgtttgaacctagtagttctgggaccttagagtcctttctgtgggctccctgtggcccagatttttggtggccacgtttaatatcaagcctagcctaatttgcaaagggtctcccagggttaatttattggagtgatcacatggagtagaccagagtctgagggcagaaagctgtcacctgcttcggcaatagaggccccagatgtctgggtgcaaaagaactccatagcaccccgaccaacatggtgaaaccccgtctctactaaaaatataaaaattaggccgagcacagtggctcatgcctgtaatcctagcactttgggaggccgaggcaggtggattgcctgagctcaggagttcgagaccagcctagggaacacagtgaaaccccgtttctactaaaaatacaaaaaattagccgacgtggtggcatgcgcctgcagtcccagctacttgggaggctaagacaggagaatcgcttgaacctgggaggtggaggttgcactgagccgagaccgcgccattgcactccagcctgggtgacagagcgcaactccccctcaaaaaaagaaaaaaatatatatatatatatatatatatatacacacatattttagctgggcatggtggtgtgcgtctgtagtagtcccagctacttgggaggctgagtcaggagaatcgcttgaacctggaaggcagtggttgtagttagctgagaacatgccactgcactccagcctgggcaacagagggagactctgtctcaaaaaaaaaaaaaaaaaggaactacataggatgaacatcccagatcagggaatgttgactgtcgacagtatcagtatctacagtggctactgtctgatgtagaaagaaatgggatcaggctaggcgtggtggctcacgcctgtaatcccagctctttgggaggctggggcaggaggatcacaagttcgagaccagcctggccaacacagtgaaaccccgtctctactaaaaatgtgaaaattagctgggcatggtggaacatgctgtagttccagcttgaacccaggggtggaggttgtagtgagcctagatcacgccactgcactccagcctgagcaaaacagtgagactctgtctaaaaaaaaaaaaaaaaaaaagagaaatgggacctccgtcttagactgaagaattcagttctacgtgcttagcagtgaatacttttgtccaaggtactctggcaggaggaagaggcgtgtcctcttgagttcttgacttgggctctggcctgttaatatttccatgttggtgaaaccagaggcagcactctaggtgaacgaactttaggcagcgcagcctcctagtcttatggaacatctgaggcagaagaaacctgagtccaaccttttcattttatagatgaacaaacagatcctgatgggacagtgtacccaaggtcacccagccaagaggctgagcaggactgtacgtcagatccgtttacctcagtccttaatgcatgcagtccagccagattaagggacccttaatactgtcagctttccccactgtgggatcttcatcctcttgacttcttttgtagccagacatctgggcctcttgctggagaaggtggcagcttgctgctcttagactctagtctactccatgtggcatctggatggcactgaaattttctcaagtgccttgtctgttgtagataatgaatctatcctccagtgactcagcacaggttccccagtgtggtcctggctgccctgcccctgccagctgcaggccccacccttcctgtggccaggctgatgggccttatctctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaatttcctttcttccaagccagtgattctggttcttggacaaggtgttgaggaacactagaaacagaggggactgtgacctggggactttttctgcaggaagaaaacagcccaaagatgagagtgattcgcgtgggtacccgcaagagccaggtgggtgcaggagccggggtggaggaggtttgtcagaacagttatgatgctcacagcatcacaaattgggggactcagagggttagttcctagtatgaaggagatggggtggctgggcgttaagttccccgggaaatggcagattacattctatggcaagatcatccctaggctgggaaaattgttggagtgcagagggctcccaagccccttctcatgcccagatggaaattccagtcccttcaggatctgcctaacctgtgacagtctaaagagtctgagccgtggctgggaagggcaggactaatccaaatctctacccgcagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaaggtgctttcctctgaatacctccagctctgactacctggattagcctggcatttaacatcttgagctttgggtctttttatgagtgtttctggtcttcctgctcgattgtatatactcagagggcaggaaccagggattatgtgcctctgtccccatcatgaatcgtagcacagtgctaggctcagtaaatgctgatcaataatgagcacctgattgattgactctctcctcagttgctatgtccaccacaggggacaagattcttgatactgcactctctaaggtaacaacatcttcctccccagttcttgtccccactcttctttccttccctgaagggattcactcaggctctttctgtccggcagattggagagaaaagcctgtttaccaaggagcttgaacatgccctggagaagaatgagtaagtaaagataggagagtgtggtgccctcccagtctcttgctgggaccctagtatgctaggtctcttgctgggacccggggtgtcagataggctgctgggcttaaaccctcagagaggctgaaggcagctcataggtgggttttttcaggcttcagaaaaggagagtgtctggttctgagccatctggctgcctggactgcaagaatggctgggggagggagggtaggagggagagtaggagggagagtgagaggagagcagttttcatgctcctgagatcttgagaaggtgtgcttcctgaactgccctaggctccaccactgaagtagaggcaggggtgggtggagaaggggtgaaggctggctgctcataccctttctctttgcccccctctcccatctctatagagtggacctggttgttcactccttgaaggacctgcccactgtgcttcctcctggcttcaccatcggagccatctgcaagtaagagtcttgcaagtaaggggcttgggcaggggtaggcatcatgtgaacctttgcctttccctttggggcctgaccctctgcttcagggttatctcctctgccctgaggagtgttgactggtggcagaaaactcaagaaataccagtgagttggcaatcgagagagaatagaggtgatctgaacttaaatctcttccctcattctgtgcccttccctcctcccccaggcgggaaaaccctcatgatgctgttgtctttcacccaaaatttgttgggaagaccctagaaaccctgccagagaagaggtaagtggggcctggataggcagcttggtgggatgtgcccagaagatgcagggatgggaggaggaggaaaggaacagtgactgcctagtgttaaaatctcattgtaacttctctctgggcagtgtggtgggaaccagctccctgcgaagagcagcccagctgcagagaaagttcccgcatctggagttcaggagtattgtatccttttagaagagtgacggatccttttggaagagtgacggagacagcagccaaggaaaaagacaaggtctagagggctctgggagtccggagagtggaaggggcttccagcaagcagcccgtggggtcagtggcctgtctgtctttccatgcactcatccgtccactcatttacagtctaatgttttcttagccccagacaagtgttcagagtgcaaggcattggggataatggtgagcaagataaacattcccctgcatatgtagagtttacgtcttacttagggataatgcagttatactgaactgaatagtgactacttctggagggatagggagtacttcctttttttttttttttttttctgagacggagtctcgctctgttgcccaggttggagtgcagtggcgcaatctaggctcactgcaacttctgcctcctgagttcaagcaatcttcctgcctcagcctcctaagtagttgggattacaggtgccaccacacctggctaatttttgtatttttagtagagactgggtttcaccatgttagtcaggctggtctcaaactcctgacctcaggtgatccaccagcctcggcctcccaaagggctgggattacaggcttgagccccgcacccggtcagtacttccatttttatatgctactatattgtcttgacttttacaatgaatatgtagtacatttcataaaactaaatttaaaaatagtatgtgctaagtgctccaataagtgaagttgggaattttctggaaacttctagttggaacatctaaacacagaagtctggggtgtcagggaaggtttctcagaggtcttgtaaccttggcaagttatttagcctccctatgtcattttccttatctgtaaagtggggataataatactaccttcctcacagggttgttgtgaagatgaaatgagctgacatatggaaagtacttttagagcagtgtctggcatgtagtaagtatgatgtaactgttagctgttaacattaagctgagagctggaagatgactgaaagtcagccagctagagagggaaagacagactcaggcagagggaaccgcacgaggccccagattgcccgacactgtggtccttagcaactctccacagcggggaaacctcaacacccggcttcggaagatggacgagcagcaggagttcagtgccatcatcctggcaacagctggcctgcagcgcatgggctggcacaaccgggttgggcaggtagggcctgcccctatcctctccccagctcatctgcatctcctttctgccttacagtcatccccaatttaggatttttagactttatgattgtgtgaaagcgatatacgttcagtagaaactgtacttagtacccatacagccattctgttttttactttcagtacagtattcattacatgagatattcactttattgtaaaacaggcttggtgtcagatgattttgtccaactataataggctaatcttaagtgttctgagcacatgtaaggtaggctaggtgtattaaatgcattttcagcttgttttcaacttaacaatgggtttatcaggatgtaaccctattgtaagtcaaggaccatctgtcttcacttcttgaccaccccacctctaacaccgtaggctgggaagattgtgaatcagaggccagactctaggctttcatggagaaaatttacaaaaaaaaaaaaaagaggccagactcacacttaggcctacccaggctttctagatgatagggaactcccatctcactgccaggtgcttttagacacccccgtgtccacccttttgactccctgttccgcctccacagatcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtcccatgctttgcgccattggttggggaaagatcaggcctgatgtcctaggatgtttttccatcagggggccttgggcgtggaagtgcgagccaaggaccaggacatcttggatctggtgggtgtgctgcacgatcccgagactctgcttcgctgcatcgctgaaagggccttcctgaggcacctggtagggcctgtgctccacctgtggagggctggggacttggagagctgggaaaggtggcagggaagatttcttacatgaatgctctgtatacagtgctaactcattcttgttgaatgttgtgtatggataggaccaggtctgggcccacagttgccttttcagtgatgtcctcaggtctgtggtcacagggtggtgttaagagcccttgcagctcacaagaacttcttgttacaggaaggaggctgcagtgtgccagtagccgtgcatacagctatgaaggatgggcaagtaagtggggggaaatgggcgggaagccagggaaaggaggactgtggcatttcttcctgtgcatcccaggtttctaggtagtcccctctcagactgtgctgaggcaactgttttcttccccagctgtacctgactggaggagtctggagtctagacggctcagatagcatacaagagaccatgcaggctaccatccatgtccctgcccaggtaccaaagctggagggcgagggggtaataaacaagagtgcatataatctcttgttctcaccaaatcccacctccttccctcatacagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgttgtgtgtgcgcgtgtggagttggcgggaagataggaacaaacacaaagccctttcatccttacctcagaggctgggacttttgcccagagttctcctggtacgtcctttctgcttctgcctcaatagttttcatttcacacagaataaattgtctcccaggaacaccaagaaacagagccacaatcttaaattcctatggtttgccccttcagttaacagtagagcctgtttatattgcatggcccctcccacccctattatcaggaaagtatagaaagtcactaattctacaactctcttgcaaaatgaaaacaaatgctccatttaaaaaaaaaacaatcctttaataaaattagtccatctaaaactccccaatgcctaaggttctagtcgtggaagggttagctgcagaattc

SEQ ID NO: 2431 - DNA, 1618 bp, Homo sapiens
  Genbank Accession No. M95767
atgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacct

SEQ ID NO: 2432 - DNA, 6082 bp, Homo sapiens
  Genbank Accession No. M96233
caccttgacacataggccacttcctgagcctggacccagtctcagagctggggaactggcccaatgcaaaagggtcgggagcatctgcaacagagactgagctctatcagcttcggtgacatagcctccattcacgctccccaactcagcagagagagcacaccatcagacttctaagacttagtagccaagaagtgttgaattaaactctctgagacctctctttagtctgaccctggcagcctcagtctcccagagcctgtgggaactcggcagccgagaggcagaaggctgggcgacgtccggagaagaagaaacgggggaagaacttttctcttacgatctggctttactctcacgcgcacagccgagtccctggggacccagcagaggtccgaagcggagcggggcggggcggggctacggaagctggcgaggccgagcccctcctagtggttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcggggtgagtgagggtccgctgcactgtgggaccgggcgcgtgggcgggaagtgccgagcggctggggaccggctctagggacggttccctccttagggctatctctcacaggagggcctgtgcatgcctgtgtgtgtgtgtgtgtgtgtgtgtgtgtgtgtgtgtgtgcgtgcgccggggtggggggggggtgcagtgcagtgtagactaggggctcacctggtgcagagaaagtcaccaagtcagggaccctccatctctgacacgacctgcgggccatctcttccagctggcccacgccatgcgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatgtaggtgcaggggaaggggcggttttgggggaaagtgcgacgtgtctctgactgcatctcctctccccagattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggccccaactgagcttccccggtttcccatctatccagctgccctacttgattgatggggctcacaagatcacccagagcaacgccatcctgtgctacattgcccgcaagcacaacctgtgtgagtgtggttggctgcagtgtgtggggggaaggtggcatcctccttggctggattggggtgctatgctcagagtgagtctgtgttttgtgggtggcaggtggggagacagaagaggagaagattcgtgtggacattttggagaaccaggctatggacgtctccaatcagctggccagagtctgctacagccctgactttgtgagtccctccctggtctggaccagaagccaggcttgtattcccatctactctggtcctattcacaatttgaactcctcactgctattgatcctctgagggttccctgtactgtagcagagtgactgtcatatcattaaacttataaaataaaaacttgaaatcagtccccaccaatcataggaagtcctatgaaagctagcaattcagttcctagacaataaagtcatgcgttcagaattcccttcacctctgacccctgacctctgccacgggccatctaacccagctggttcatgccatctgcctgttcggggaatacgcagactcacactatggggtaaagaagtatgtagtgggatgtaatagcaccctcctctgtggaattccgtgctattcttttcctagtgcttctccttgacacgcacagggatgaatgcattttcctaacaggcagctcaggggcggccagagggcctttgttcctctgtctccttccatgcagcctctcaaaatctcatctctccagaaactactcaatgtccattgtattattctgccactgcactaggaggaactttcaacttctttctctgagctcctttagttctttgtatccttgattttgctcgtgtctgggtccagagcctgccaggtactcaggtgctcctgggctgacccagaggagggtggttgggaggtcagtggggacagattcagggatagtgttgcattcctctctgccttcccatcaccacaaaagcctccagctacccatttggagtgtaataaatgctggtatgtccagctgaagccagttccagctgtggggaagatggctgcttgctcgtggccagctggggccatacacagccctggggaggccacatctgtgcagggagcttgtgtctgagggtggtgacagctgttttctgcctcaggagaaactgaagccagaatacttggaggaacttcctacaatgatgcagcacttctcacagttcctggggaagaggccatggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctgcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggctcatccagcctggatttcacagcccagggcactttggaagaggcagagaactttaggagcatggatgcagctggcaatagtaggactgacacacggtggcattgacgtcgagtacgaaacccacaggcagtattcatagctactcccagaagctttgcacgatcagacccccacgtggggaatcctgagagccagagctgtggccagagctggattagggtacatatgtgggtgcccctgttgaaggagtgtatgttgaagtgctctgtgctggggcactctccttctttatcttttttcctctcttttttccctccagtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgaggtgtgtggcaccacctgggtaccaggcctggggcctgcccctcactcatggggaaccatccctcacccgtgctgaatttgtttgagagcagcaaatcctacttttagtacagatgtgagaatttgaggcattagtccaacaagtttttcagcctagaatttgttttcctttcccactacccatcaagggatctggttactcagctagttcccatcagctctggctgtggtctcggctgagtggccttggggttatgtaagaggtagtgggaggggaagagagctgagggctgcagcatatggtccacctgggcttggcctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttgggtgagatctgggctctcttccaggctgcacagacattttcagaggtcccctctgtgtgtgcaaacctaggcaagccaggtgcctccctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcttatgttgtaatttctcttgggtacagagcacccagcaccgtgtagaatcttcataagtgttagctgttactgtggtacaacattacttaaaggaagttggaagagttaactccgcaaatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccacatttgctatagtcttgtcttatttgctcctggc

SEQ ID NO: 2433 - DNA, 2601 bp, Homo sapiens
  Genbank Accession No. M96739
aggtgtgtgtgtctgagggtgtgtgtgtgagtgtggctggcccagtacctgccaagcccaccacttccacctgggccctacacccccacaatgtgtacccctcttatctgccctggagcctgtacagccatgccacgctacccctgagagtctagaaagctggtcactaactttgcagacggatgagccttgagcacccagaggagactggggctgtcaacgctgccccttgtcctgccggcttggatcccctgacagggtccttctaggcttcagactggcaccctgaccatggaaccctgaagtggcagtgacttctagagctcagtggcagaccccacgacccttcctcccccttcctccccctcccaccaccagctttcaagctcccagagggaggggtggggaggggatcctgatctcacagggcagggggcttccatcatgatgctcaactcagacaccatggagctggacctgccgcccacccactcagagactgagtcgggcttcagtgactgtgggggcggggcgggccctgatggtgccgggcctgggggtccgggagggggccaggcccgaggcccagagccgggagagcctggccggaaagacctgcagcatctgagccgcgaggagcgccggcgccggcgccgcgccacagccaagtaccgcacggcccacgccacgcgagaacgcatccgcgtggaagccttcaacctggccttcgccgagctgcgcaagctgctgcctacgctgccccccgacaagaagctctccaagattgagattctgcgcctggccatctgctatatctcctacctgaaccacgtgctggacgtctgaactcagcctgtctcccacctcccgggcctctctggggcccctttccaccgctcactgcttagaaaggccgcatcctccccgagcccttataccttggcatggagtcccaaaggccctgggcacaggcagagagcccaccggctggtcatgagggcctcttcctttctctgacccaggcacctcgagggctattctcctgggttccttccggggtttattgctgaggcccagctgtgcagaattgtttgctagtgtggttggtatggaatccttgctggctttactaagccagccacacttggagtctgcccccaagctctctcactgaatgctgcctcttctacccctatgtccaaattttcagccaccacagacctcagctgtgtatcctatctgttctagcttctcctgcccctggtggggatgggctgtcagaattgcaagggaggaaggctggggttagagtggggagtgggcttcttcctccaagatctcagtctctcagtgcttggcagaggggtgaggccctggggaggcaggggttggtgccctgactcctgtgaggggaatctcagtagctgggaattatggaaaaactcttcctgtttctgtccatcttgttcctgtggcttagcacatacagacctcagatcttacttggtagtgagtgccttgccctctttgagctatttggctacttccctgtccctctgactcctactgtcccaattttctccctccctgtgtgtcactagagaaaaaaaaaaaacaaaaacctagattccggattaggggatgacatcccaaacagcccggagtatttgcagaaggctcaggcaacgagtgggccacatctcacttctgcttcctcatctcagcccactctgaaaatgtgcagcaccctcactggttcctccccccaacgcaaggaggatgcccaattgttgccctctgaaaatgcacagttctcctggccctaggacttacttattacatttttttctctttccttgagctgcctttggcaagggaagagacccccaactctgcgcccctactccatgctgctgatccccacctgcgcactatagcgcagggtcagcagtggaatgaagggccttagaacctgcatagaagaaatgaactcactgcatttctgtgctccctcctccctcgcaccaaactcctagctctacaagatatttatttatttatttatttattcatctatttatttacttatttatttatttatttataaatattgctatttattgccgagttgtgcactttggggtagagtgaggggctcccagcagctctagctgggtctctcttgcttcctccctgcttacgcctttccttttcttgctccttcttcaactcctggtgtgtgtgagcatgccctttgcttgccacaccatatcctttccccagatccacctgtcctgacactctagtcctccaggatagtgctcctcccccagctccagggctcctggatgtccttcctcaactccctccacccctagacaatcctacctggtcccatctgcctcttttctctccccagcctgccctgtgacccttgcctcttcctgatactcccaagagcaggccccaggggtctgtgtcacatatctctgtgtgattccttctggttgcatccccaatttcatacaaaaagaaaaataaaagtgacctcgttctagcaccaggaaaaaaaaaaaaaaaaaaaaaaaaaaaaaaaaaaaa

SEQ ID NO: 2434 - DNA, 1167 bp, Homo sapiens
  Genbank Accession No. M96843
attctgagccaagtccggtgccaagcgcagctagctcagcaggccgcagcggtggcctgagcttcaggacagccagctccctcccggtctcgccttcctcgcggtcagcatgaaagccttcagtcccgtgaggtccattaggaaaaacagcctgttggaccaccgcctgggcatctcccagagcaaaaccccggtggatgacctgatgagcctgctgtaaaacatgaatgactgctactccaagctcaaggagctggtgcccagcatcccccagaacaagaagtggagcaagatggaaatcctgcagcacgtcatcgactacatcttggacctgcagatcaccctggacttgcatcccactattgtcagcctgcatcaccagagacccgggcagaaccaggcgtccaggacgccgctgaccaccctcaacacggatatcagcatcctgtccttgcaggcttctgaattcccttcggagttaatgtcaaatgacaggaaagcactgtgtggctgaataatcatgacttcttttttttctttgcacaacaacgacaacaacaaattcacagaaccttttcagcgctgaacttatttttcaaccatttcacaaggaggcagttgcatgacttttaaaagcaaaaaaggagaaactagatgaaaaagacttttaaatgccctttctgcagttggaaggtttttttcatatactattcccaccatggggagcagaaacgttaaaatcacaaggaattgcccaatctaagcagactttgccttttttcaaaggtggagtgtcaataccagaaggatccagtatcagtctcttaaatgaagtcttttcggtcagaaattacctttttgacacaagcctactgaatgccgtgtatatatttatatataaatatatcttatttaagtgaaaccttgttaactctttaattagagttttcttgtatagtggcagagatgtctatttctgcattaaaaagtgtaatgatgtacttattcatgatgaactttttataaaagtttaaacttttagttgtaaacgtaacccttttatacaaaataaatcagtgtgtttattgaatggtgattgcctcgtttatttcagaggaccagtgctttgattttttattatgctatgttataactgaaccaaataaa

SEQ ID NO: 2435 - DNA, 2561 bp, Homo sapiens
  Genbank Accession No. M97856
gcctgagtgagtctctggcgtcccaaattgcctgtttttctcgcaggctctattccgttcgctggttcgccacctcaggggaacgatggccatggagtccacagccactgccgccgtcgccgcggacgtggtttctgccgacaaaattgaagatgtccctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgcaaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctgcttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtcccgagtggaaatgaagtttcggaaaacatggaggaggaggctgagaatcagctgaaacgcggagcagcagtggaggggacactggaggctggagctacagttgaaagcactgcatgttaagagggggcacagcctcctcccaagggaaagtgtttttgtatataatgtattttttcacttttggaggattctttttgtataacttcaataaagattgtaagcaaaaaaaaaa

SEQ ID NO: 2436 - DNA, 2216 bp, Homo sapiens
  Genbank Accession No. M98399
atttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgctttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttcctt

SEQ ID NO: 2437 - DNA, 1443 bp, Homo sapiens
  Genbank Accession No. M99439
cctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgaccccctcatcggacctggaatcccccggcatgctcgccagatcaacaccctcaaccacggggaggtggtgtgcgcggtgaccatcagcaaccccacgagacacgtgtacacgggtgggaagggcgcggtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgggaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacgccttacggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaagga

SEQ ID NO: 2438 - DNA, 442 bp, Homo sapiens
  Genbank Accession No. N20113
ccattgaacacatttttattgagcacctattatgtgcaccagacactgttccaggcactggcgatacagtagaagataaaacagacaaaaataccagccttacagagctcctaaagcctatattccagtgaaatcaagataggagaacttttcccttaagtttaaggtagttaaaaaaaaataggagaactaattcatggagaacatggccaagttatgagccaaagcacaattcctctgaagagtaccaaaacaaattctctctctattgcttaagtcagaaggaaacaatgaaacccctgagggtccaccacaaaagacagaggccccgctgaacccccgacccatgcttgagaaagccagggcccactctccctctctcaaacagttttagggtagagaagtcaatgcttagggctcctcactgggagacacaagggca

SEQ ID NO: 2439 - DNA, 476 bp, Homo sapiens
  Genbank Accession No. N20198
  unsure (1)..(476): n = a or c or g or t
tttnttttttttttttaaatattaacgcacactttttattatattaaaatcaggcaatggtctgacaataaaaaggctgcttatggaatactgttatgttaaacttcacttacaggatgttaaatccttagaactaaggtattccccccagaaaaagnttantnggnaacaacaattgnntttcagacntganagttgcngntcaaaagggggttttacacaaatactaaattaaaaaaaaaaaaaaaacctttagtacacaatgaattgcttttatttcggtatgcatccacatttcagcatttagnggtcctgaacagcaagtggaaagaccgcagcaatttgccaggaggtcaagcccaccaatttcggggatctgctgtgcacaccggggttccttcttaatccctgctgaggatcttgggaagcagcagcagcaccaaaaccaaggcatgcaccggattcaaggttcnttt

SEQ ID NO: 2440 - DNA, 460 bp, Homo sapiens
  Genbank Accession No. N21079
acttatcatgacaactcaaggtgacatgaatatttaatgaaaatttagaatataacaacatatgactctcattctgtggacataaaaggaaaaatacagtaattcattttactcattacattttacaaaatcagcccaatgaagcagtattttttaataaaaacagtaatttaatttcaaacaaatatattaccatcctattcctttatcttgtatatatgtatctaattggcaaaacatactttactgaaatcagtaacaatccaatccatgatacttcaattgcttcgatcaataaacatcttaaatttgaaactcatttttcttatgccataagcctgattatcagttctataaaaacgctacaccctattgcttggcccattaagtgtaactagtcttctgcacaaggctaagtgggctaaggtacttttgaacaaccacacacaattcatcaagc

SEQ ID NO: 2441 - DNA, 464 bp, Homo sapiens
  Genbank Accession No. N21359
cttaatacttatctttattatgaaagtgtttccaaagtaaaatgatcctcataataatgattgcttccagagatcaagaatgaataattatattttcatataaaaatcagcaaaacacaataacaatacataaaataattctaattggctaacagtatttcattccatttctgacagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaaatgactatgtgggcaaagagttgatgaaaatcatggagcttaggggctttatgaaactttgggaaatcaaactcagaggttgttttccattcttaaagtaatgaagctctaagttaaagtttcagaatcatcacataactgttcctattcca

SEQ ID NO: 2442 - DNA, 485 bp, Homo sapiens
  Genbank Accession No. N21407
  unsure (1)..(485): n = a or c or g or t
atttttntttttttttttaagccttcncaatttttattaaatcctagtctagttgaacaatatctgatgttacagacatcatcccatggtgaacatgtttaataagtgaaagcaagtcagacatctcatctaagtcattattttctgcagactaagcaataactacacagaacactatgggtaaacaaacacctgctcagttttcacacaagccatgttgtttatcaaattagatctgctaatattgaatacagtagattcggtgattgtagttctcatataagtatcttattgagataacattttgacagtttcactngactttccaaataagcataccataatcnaagaaaagaataaagagtgaagtaaaaactgaacatgaagagatttaagttattaaaggaaaatgaagtaaataaaaagagtgaaaaaccttgggggtggaagtcnaacaagcctagacntttgattgggnagagaaa

SEQ ID NO: 2443 - DNA, 413 bp, Homo sapiens
  Genbank Accession No. N21550
  unsure (1)..(413): n = a or c or g or t
agtttccaacattttattttttcacgtgtcttgccatagacctctttgggttttatcctatttggggtcctcacagcttcttaagcatataggtttatgtctcttgccaactctgggaagcttttagccatttacttctttatgttttcaggcttgtcctcttcctcttccccttccagacatagatgacaacatgaaagtgagaccttttgaggtagtttcacaggtgcctgaggttctattcactttctccccgagtctattttttccctgctaagattgtgtaatttctactttttcattggcagtggatggatttccttgctctgcaccatccattctgctgttgagcctatgtgccagactttttantttggtggttgtanttttccacttctaatacttcatttggg

SEQ ID NO: 2444 - DNA, 189 bp, Homo sapiens
  Genbank Accession No. N21626
  unsure (1)..(189): n = a or c or g or t
taaaggcacagctttcccagtgtttgtgttccttgcttgcgccctgttttaatgttgtagttacaggtgtccagcagggaggaatgcagcccctgtgggcattgggggagctgctgggaatccaagttcaaggagcagctgttttctgttttctgttgccccacagcgccanctctgggccccttgggg

SEQ ID NO: 2445 - DNA, 464 bp, Homo sapiens
  Genbank Accession No. N21646
  unsure (1)..(455): n = a or c or g or t
tctactcaaactataagcttttattattgtattttacagatcattcattcaggacatgctgcatctggggttggcatcatttcccttttgaatgacagaatgtgcataaaagtctcttgcccacgctgaactcacacgtgcccggcagaaggagctctcacgaaggccagctggatgtgagcttgctctggcagcagcagtgctgtccttgtttctgagctgccacctattcactggagttaaggtgggtcaaagctgaaatttagcttggaatttaaagtttctaattttatacttttcattgtggtctggtcagattttaagtctgctttaaaatcaaaaggtcactcagtcactctaatatggatccattttngaatatggaaatttggttatttacatgctgtacctcaaatcaaagaaaagcacgcctcaatatcacgcgtagggaaaaactaggaaaa

SEQ ID NO: 2446 - DNA, 364 bp, Homo sapiens
  Genbank Accession No. N21648
  unsure (1)..(364): n = a or c or g or t
gtttccggattacatatttaataacatatttactgaggcaccatataaagggttccgggagtctctaaagagctggagctacaagaagcctaggcagggttagagtaacaaatgtgtctatgaagagtggggatgagtggcatttgctgggatattgggtgtaaagttgataaggtcatgaaggttcaacagatatttatggagtgcctagtatgtggtgggaataagactattatcaagggctctaaagcagtcagtgtacattttagagtgaagaggggcattgcagggtgctantcctcttaagctcctgaccggcaacccaaccccgtggaaacttggtatngcccncttttgagggagg

SEQ ID NO: 2447 - DNA, 330 bp, Homo sapiens
  Genbank Accession No. N22015
tgtggataaatatattagcaaataaatatatttcttaacatagtgcctgattcaagcgtctgtctggttcagatataaatacccatgtgggtacctaggtgctagtctccccactaactgagggaaaaaggttcccaggtggggtcctctgcccactttgccaccacattcacattccaaatgggataatgcctgaggggccaagagtggtcaggctgccctggggtgaatgtcaccctgatgaggcccatcagctcttgtccactcagtgaggccagacttgtgctctaatccactctcctgtgggtccctggcctgtatggcttatac

SEQ ID NO: 2448 - DNA, 385 bp, Homo sapiens
  Genbank Accession No. N22107
taggtttaatgaatccacttcctttattgcagtaacctctgtacaaagcagcaactgcaatactcaaggttaaaacattagaaaagcatttgtgtgacaggtatattacagtattatcaaaatattacattttcagacttacttagcagataatcatccaccagagcttaaatctttaaattatttccatagtcttaaaaaatatgtaatgtcagaatgcatataaaaagaatgtaaaaggaaacctaaaatacaaatggaataatgtaacaaataaatatttgatttcagtaactgttaataatcagctcaacaccaccattctctctaaactcaatttaattcttataggaataatgaactgtcaaatgccatggcataattt

SEQ ID NO: 2449 - DNA, 356 bp, Homo sapiens
  Genbank Accession No. N22404
ttcttattcaataaactcttttattctagtccacagatttttccattacaataataatgaaaatagcactagtaatttgtaacactgaggcccaaagggaaacccctcctcaaattataaggtaaatgacacaaagttgaacatagggtcagtgttgggcaaaaagcatttaaaatatagataacggggtcaagattttgtgtgtgtgcaaacactggggttttgtttttcaggatgacaccattttagaaagtgcatgattttgaaaactatatgtgtaattgtgacaaaactaaactgtagagaaaagacaaaatcaagcaaaaacaaaaaccaagaaaccaaaaggaagcaaa

SEQ ID NO: 2450 - DNA, 305 bp, Homo sapiens
  Genbank Accession No. N22434
taacaaacaaaactttattttcctttaatacaaaattaaatagcaaggggttttctttgtacagtgataaattagaaatttacagtacagacatcgatgcagacatacttttgtacatccttaaaagcagggtccatttcctttgaaatttagcaattcattcagggcatgtgtagcaggaagtttgcctggtacctctttgtcaaacatctgaaagtcccccagattggcttcaaggttcctggagctgtggggtggcatgaggacccaagaaaggccacagagcatccagcccgactgctgca

SEQ ID NO: 2451 - DNA, 345 bp, Homo sapiens
  Genbank Accession No. N22854
  unsure (1)..(345): n = a or c or g or t
tttttatagtaattcgcattttattattttatcattatgaatagtaaagtccacagttcagtcctcagacaacattcaggtaaatgttttacatatgagacacctgcctgtaatgtgatgacatgagatatatatatggatatatatatatatggatatatattttgaaccactgngatttactagtctattaaaatgccattacncatttaaaaactgaacaattacaacaatgcaatcttcaagcaattaaaaacaaagaattgttgagccaacatgggagatctgctgagtaatctggcctttcaangtaatgnctagtggaaaccctgttttctccttcca

SEQ ID NO: 2452 - DNA, 375 bp, Homo sapiens
  Genbank Accession No. N22938
  unsure (1)..(375): n = a or c or g or t
aatttgacaaacatttattgaacacctctaggtgccctataccagttcctggggacacaaagctcagtgaccctgtgtccctgtctgggggganaagtgtgtggctcacagccagtttccctgagagcagaggagcaggaagctcagtatttcttaggcaggccgtcagtctgaagcggtcggggtctttgccactccggccccattcctcagctttctcgttggacttcgagtcctccaatacagtgctgctggttccaaataaatagnagtctattaatccctgaagagtagaccctngaacggctgatgaagtttaggagnccagganaccccccaaggtcctcttttgggggcagcatcataagnttcccc

SEQ ID NO: 2453 - DNA, 442 bp, Homo sapiens
  Genbank Accession No. N23319
gaagaggacatcttgtaataaatttattgtattttgttacattttccacttttctcttaattccaactgtatactatataatcaacgctgtttcagaaataaaatgtttcaaacgtaaaaatataaattctgcttcttaaaagtgcatacactttgaataataaaacatacaaataaataacagaaatcagtgacacatctcatgcacttgttctaaaataaatttaaaatgtacgatacacttttcttccagcctctaggaaagacatcctgccttccatattactgtacaactgaaaatgaaaacgacacagaaatcactatccacggtgcatgagtaataccaaagcactttgtgtacagtgatgtgacatgcagctttcaagacaactacagaaattccagtgtaaaaactgaagagttcaatcaagaaacgacttat

SEQ ID NO: 2454 - DNA, 490 bp, Homo sapiens
  Genbank Accession No. N23665
tttttttttttttttttttacagagtgggaaacaactttaatgagaaacccagtttcccagtttccctttcatttcaagactatgacattccgacttctttgagggcttccattgcctaggtggcctttttcttgtagttaggcattcttagagctctgggcatgggcttgtcttggccaaaatgtcttttagcaaagtaatcatatatgccaataggaaatagtgagcaaggcagatccacaagtaagcgcctttccctggcgtgtaataggcaaaagggctcttcgccaagatagcatgctggatgtcccgcagcaccggagagaagtccttgctggctaacgagttgatcaataggaggaaattccgctgtgctaagatgtagtcctggccgtagtcttcctgtacctcagcggggaggtggtccagaatgtccttctccagcttttcccacttgtcactggtgcctgcgatatttgttaagaagcc

SEQ ID NO: 2455 - DNA, 375 bp, Homo sapiens
  Genbank Accession No. N23730
  unsure (1)..(375): n = a or c or g or t
tcgcattcaacttaaatgnttaacatngacaatgtcttggaacaataagcaaacaatgcttaaatttttcattcaaattcactttccacatgtcaaaagacctcaaggtagaaaaaaataaaataaaaatataaatatctgagaatccatcttaataaataaattaaaaacncnnnccaacgttttcacnnccccntgttaatgtcagaacattcagaccacctcaacaatgcatgatcagtaacattacaatgaacattgatgttgaagaaaaactacagtacatggatatagctatttatttctatctaccagaaaataaagtcgtatcttttcttagtataatattggtcatttctaatcagaacacactat

SEQ ID NO: 2456 - DNA, 419 bp, Homo sapiens
  Genbank Accession No. N23761
  unsure (1)..(419): n = a or c or g or t
aaagatgataaatcattaagtttataacacatagagagtataaaccaagaaagtaaatttatttaaattactaaaatagcttttaaagtcatttacagatcagctgctataattatttttcctgaaagacataggtaacatattacttttaaattacttgggtcaatgaaacatttaataaaaacatttgtttctctatataatacgtatgtataaaataagccttttcaaaaactctggttttcataatcctctataaatcagatgatctgacttctaagaggaacaaattacagtaaggggtatacatttatgaatactggtagtactagaggaaagacgttaaaccactctactnaccacttgtggaactctcaaagggtaaatgacaaagccaatgactgactctaaaaacaata

SEQ ID NO: 2457 - DNA, 593 bp, Homo sapiens
  Genbank Accession No. N23817
  unsure (1)..(593): n = a or c or g or t
ttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttggaataggaataggtaacacctccagcggtacctatagaaaatgcactccagctccaactgcctggtggtttnaaaatacacattttaaaaccccncttttaccgncacctaaccatnaaagtacctccttcctggggttggtaaccatggtgggtaggncccgnggtattggaatagcccatggttaataaaagcccaaa

SEQ ID NO: 2458 - DNA, 490 bp, Homo sapiens
  Genbank Accession No. N23868
tttttttttttaaatgaccaataaatattttaatcactgttaaaaaaaataaaaaccttgtactcctacgacttactccctccttgtctccacccactcctccatgagaaccgagttgggaatttccacgggaagtcgggggtggcggggagagacagggtagaaataaagagcgcatccttgagagggggtaggttctaggacaagggtggggctcaaaggccttgtctccacgacaacacaaacacagacttcaggcacagactacaaccacctgacccctgaccctgtgactgcaggatgttcaacacgccccctctccctccctccatgtgcaatctactctgtggagcaggggcttcagtgtacccatcagagggaaaggaagggtttagttctggaaataccttgggggggaggggttgagtagtagaatgggcgggtgatggtgaaactgtggttccccttccagaatatatacaagtccaca

SEQ ID NO: 2459 - DNA, 425 bp, Homo sapiens
  Genbank Accession No. N24879
  unsure (1)..(425): n = a or c or g or t
aanaaaaggccctcaaatatatacagacaaaaaattactgtgaagattttttcgggaaaagctaccaaattcagtgttgtgagaaaaactggtaaccatgcagaaattttaacatctatgaattttttttccaaaatacacacatatttttttaaaaaaggaattctgtgtcaagtataactcaaaataaatacaaattcacaagtagaactattgaatacttcatatggggtaaacaccattatctcccaactagatcgctagatctaccaactgcaagcgattgtcccttttgaacgtactaaaaccacacactttcccatcccctgggctcctggccctctgagcacttaattctcaatgggcacctggcctgcatggcagggggctttgctgaccacaagagagttccccagttcagccag

SEQ ID NO: 2460 - DNA, 454 bp, Homo sapiens
  Genbank Accession No. N24899
gttgttggaaaaacatttattgcaattcagtgtcaaaagttttttacaaaaatatgccaccgtctggtacaaacaactataaaaaatcagttcatcatgcaagaaaagtgtgcaaataatttatacagaaggactcagctcacacaatattaaataaacatctctgcatgtaattggtctaactttatgctttagttacaatgttcaaccccctctaatacttttcatttaaaaaagtacattaaagcttctaagcttaggacacaggctgtaatatacgcccactttagccatggtgattggcacttggtagaataaagattggcaccaaggattcccaagtatagaatacagcttggagccttctgcttaacagacttgtgcttcgttaattaaacaaacacatctatactcaaagacagaaaaagtcatgtttaaactccagaaataatgt

SEQ ID NO: 2461 - DNA, 463 bp, Homo sapiens
  Genbank Accession No. N24973
  unsure (1)..(454): n = a or c or g or t
cctgatgatatttatttcataaatgtaattatttttctaaaacatattaaaatagaaaacatgttcttttaatcaatcaatttatacaaagaaaataccaatatagtaataaaaatactgaaaatatatgaaaagcaccagaacattagagaaattacactggcaacaattctaggaatatatttttttttgtagttgtacaataaagtgctattaaatccagtcaaaattagtggcaatatataaaaacagttatggtagtatgaaatttgaggccaggtttaccagcaatcgcatttttaggctacttgcagatcaaggtaatgatatttcactaatgctttcatggaaaatctatttaatttccattcctaagtgaaaacaaatatctaaatctaaatggttgggttccntgggtaatttgggtcntgaatagggtaatggacntggattaaaaataaaa

SEQ ID NO: 2462 - DNA, 454 bp, Homo sapiens
  Genbank Accession No. N25082
  unsure (1)..(454): n = a or c or g or t
agacgggcttggtgacccggacccggactctgtgctcaggatcctcctctgtaggttggggtgatgggggaggctttttggggacaaccctctttttcttgtgcttcttcaccagctctggactctgtttttcctccagtcttttgatgagtttgttgagagtggatgtgagagccagcattgcccgatcccgctctgactccttcttcagcccatctgggtccagctctttctctgtctccgaacggagccggtctcggtctgacggaagcaggatcccttccagttccttctcaaattctcccagtaactgccgttcatcctcatcttcatcctcatcctcatcctcatcctcctcttcttccatctctctctggccgttctggatcaaccctttccttctncggggtncctctgaaggaattctggaaggaataatccaaagggtggtctt

SEQ ID NO: 2463 - DNA, 454 bp, Homo sapiens
  Genbank Accession No. N25193
cttaaatatgtctttttttaaatgtttgcaagaaactctaagggctaaggaaatgcactgcattatgatctgggctccttagagtacaaacctcaccaggcttaagcatcatccataagaaatggtggattacttaatgacttataagtaaaacagtcattaaatcgatcctttcatactttaatcctcttatgcagagactgagatacttccatacattccaatatctgcaactttggttctattaaagtatttgataaaagcaaaacaattttgtgaccacagaactctatggaactttttttccttttaaagtgtcaggtgaacctagcgtgataaggcaatgttgcctacacatccgcgacccagcacaggagggacagcacagacagggcatgttccagctcaccatttgttgtataatactgactcccagccaggggtaacactggct

SEQ ID NO: 2464 - DNA, 450 bp, Homo sapiens
  Genbank Accession No. N25262
  unsure (1)..(450): n = a or c or g or t
gagatggagtctctctctgtcgccaggctggagtgcagtgtctctttaaaaaatgtgggccaggtgcagtggctcgcacctgtcatccaagcactttgggaggctgaggtgggaggatcacttgagcctaggagttaagagaccagcctgggcaacatagactccacacaaaaaaatttttttaattagctgggtgtggtggcatgcacccggccttaccaggctaatttttaaaaacatgcgtttttaattaccaggatttacctgataaaactactctttgtcaaggttgtaggacttctgaaaagacagaactaagctttgttgcgtttcacgaaggacagatcagttccgtctgtataggctataagcaggtaagtagtgcactctattgggtgaagggaatttctgttggtttggaaagcccaactatagctggctngcatggan

SEQ ID NO: 2465 - DNA, 424 bp, Homo sapiens
  Genbank Accession No. N25969
aaatataaaaaggtagctaaacacaaagtacagatcagaaaccctcatttaatatagattattttggaaattaaaaaatttgtaacaaggtggctttcttacccaccctaaaatgtaaataaaacctcttccccagatttatacttcatacttggtaacaacctaaaagtttttcaaatctatgaaaaaaatctaccatgaccaatttaaattacctgggaaagggcaggagaagggatcaataacagagtcagttagttgcacacagatggaaaaatgcttgcagtcactcccaaatataaccctacattaccttatatataaatcacaatgaaaataaaagtgcctacattacagaactgtgaaattttggtttaaaaaaataataaaaataaactggtggggtatcattggaataatggta

SEQ ID NO: 2466 - DNA, 453 bp, Homo sapiens
  Genbank Accession No. N26184
ttttttttggagttgcatacatttttttttaatccaaagaagtaagcctcctaagtattgcttagacaggtttatcagaattaagtaggcacaacactcatactttcagaaaagcatttccagccaggggagtaacgtggcactcaccagcatgatgtctgttttgccaacttgctgaagaacgagtaacctgaaatgaaggagcgagaatcccaccctcagccccccaacagcttcctcagcttctttttcttctgagtcacccctgaaacagtcgctgcatctaagaccagcctcgggctaaacccagctggcctgaaggctcaactcacatcaaacggagctgggagtcgcttttgcgtgtgtccgcagtttgaagtgtcctctccgaaggtggaagtgggggaagcaggtgcgctccgggatgaagtgcagggaggcaaactctggctg

SEQ ID NO: 2467 - DNA, 437 bp, Homo sapiens
  Genbank Accession No. N26186
ttttgagtttcatcaaaagaattttatttacagctttatcatccatatgccactaaaattcacctgttttctttcaacctgcactcattttgattgcctggaactctggatttaattcttccatcccactttgtatcttgcattcacttcactctctctccagcttttattctttctttctctttccctaggtccaatgcacttgacccaactcacatgcgtggactccgggaaggtactgctccctccctccaaattctgagcagtaaaatgccgccccggggcactggggaacagaaaggaatgagaccccaacaggcagaagccaagagagcggggaggagccatggcgtttctggcccaggatgcaccacgcctgggacgtgctcccccgaattcccagtgtccaggtggcccatatggccaaacctcagggg

SEQ ID NO: 2468 - DNA, 445 bp, Homo sapiens
  Genbank Accession No. N26904
  unsure (1)..(445): n = a or c or g or t
aagttttttaaaatttattatttattatttctttttgctcttgtttcgtttctcttccttgagcttctttttggagactttgggtctattggcctttctgtataggtgatacccaatgaggcccaggaggntcggcaccatggccatccctaccagaggcaaaatgcccttcaccagctttanccagtagttggctcggattagtgcaatcagctccacgtcatactgcaccactgcatccgctgggacagatggtggaaatccccgttttccataggccaagtgagaaggaatgattgcccttcgcttctctcccacacacatgtcgagaagactctgctccagacctggaatcacctgcttttggccaagttctataaccagagggtctctggtccagggaggtgtcaataatacgtccatctaccaagcttcccgtgtagtg

SEQ ID NO: 2469 - DNA, 434 bp, Homo sapiens
  Genbank Accession No. N27186
  unsure (1)..(434): n = a or c or g or t
ccattcaagaacccaaaggcttttatttttattttttcaaaatagaagtaccttttttccttttattatacaagtaacatacttacggtcaagtcagtcaaatattacataaatttatcatgcggaaagggaaaatcacctataacccaattcctcagagataactgctgtcagaatattatttcagagttctgctatacacaaatacgcatgtttcaatgggtacttccagggaccgcatggagatcccttaagttgaaactggacaaacagaacagtggatggttctagctgagatctgggatagtttctgaattcagaagtgttcaccagccacattgcatgtattagctgggaaccatatatgaaactacgatactccagctntttctaacctacaaacacagtgattacatatgggctcaacttaatgg

SEQ ID NO: 2470 - DNA, 429 bp, Homo sapiens
  Genbank Accession No. N27334
  unsure (1)..(429): n = a or c or g or t
ttttttttgagtgtggccctgntattttattccatgtgctggccctggggacccagctgggccaggtcgacgcccctggggagacagtgtggctcggcagcctcagtggcttctttggggtgcaggagggctttggggttaaggctggggaggaacaggaagtaaagtgcttgcaggggccctcggctttggccaagccaccctccctgctccggggcgggccagacggaacacccctgggctgtgaaacaggactctccagggcccagcaggcctgggtgaggggcacatactggctggcaggcatggttcccaacacccgcagccacggaggctctggcggggctgggggccggattgaggggtgagtccagaaccgattgtccgctgattgtctgcttgtctggttcgtggctgtgtcggctcttc

SEQ ID NO: 2471 - DNA, 445 bp, Homo sapiens
  Genbank Accession No. N27524
gcaattttctatttttatttttttaagctcatcaactatggttagtgttagtgtgttttacatgtggcccaagaaaattcttccaatgcggtccagggaagctaaaatattggacacccctgcctaggggaacttgtttcgtctacttggttagttgtcctaattgcattttacctgcagtccaaaggttattttagatgatagaactgcaagaaccccaaacccaaagaaagaatcgttgaagtggttgggagaggaggtcatttctgagatacatttccaggagaaatacaagtttgagagaaggagctggtagttactgtgtgcaagtgtttttctttgatggggaaggagtagttggcaaagggacaggaatctgtgtgtacatttcctgctcctgtttccttaaccaccatcctcagggcatctctgggcaccttggggt

SEQ ID NO: 2472 - DNA, 437 bp, Homo sapiens
  Genbank Accession No. N27563
cagggcaggcgacctaatgtaggaaacttaataaacccttgcattgatataatgatctgtcaggttttcatttgaacagttctccaacattctctgaactgccaaataaactgaatctaagccctattttttcttatgctaaagtgtgaatgattctggactatcttactgggaaaacatttcctaacaatgtttttaaaagtcataaggtcaaaactgcagttataagaaagaagggtgaatgcagtggctcatgcctgtagttccagtgctttggaaggctgaggcgggaggactacttgaggccagaagttcaagaccatcctaggcaacacagcaagacctgtctctacaaaaaaaaattttaaaattagccaggtgtgacagtgcagaaaggtgaggtgagaggagcacttcagttcaggagtttcaaggct

SEQ ID NO: 2473 - DNA, 513 bp, Homo sapiens
  Genbank Accession No. N27670
  unsure (1)..(513): n = a or c or g or t
ggtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctggaaagaaggagacaggggatttttttaaagagcaagaaagtcaccaatattacttctttccttccttttttcccttctttcctttcctcctttctcctttcctttcctttttaaaatatattggagnccaccaggatatggnatttgctacccca

SEQ ID NO: 2474 - DNA, 483 bp, Homo sapiens
  Genbank Accession No. N27834
taatgttcaagattttttttttcttcttgagcttgcctagcttagcttcattgtataaagttaaacttcatttctttaaaataatacaaagccatcagagtttagtaattgtattctttctttagttatttacttatctaataagaactttatgtttagcccatttcctttaacttaaaaacaaacactgccttcattgtaccaaattactcttcacaatcatggttcatttaattctgggggttgtcaggagagagcttaattaaaccagtatgaacttagatttccagagccaagtggtttcggcttgcacatcaagccacaatcgtgattttccaccagccatgtttacagtagccaaatatcctcctcaaaatgtcttattgtagtcagaattgttgtggtaaactaaatccttagtaggaagtcatatcccttcaaaaatctaagatgaagtaactataaaaagacgtgtgaaaacac

SEQ ID NO: 2475 - DNA, 473 bp, Homo sapiens
  Genbank Accession No. N29319
  unsure (1)..(473): n = a or c or g or t
atgtcttcagaagtttaacagtgatacaactttggcacgatacagattaaaacaatgtccttagaaaacctaagtacaaagaaaatcattcttcctctcctgcttggtgtcacacttcctcccgaatctcagccataaaaagtccaaccgttggcacagatcgttctcctggttatacattaataaaagggcttaggattttatggatggctctatataaaaaaaaagtccttgtttgtctcacgtctggggcatattggtgggaactggctgcaaaagtcttcatggagtttcagagatagactttgcctccaggaaatctgagtcctctccctggctggcaccactaactagtatataagtctaaggcatgtggctggaacctcactaaagcctcagttttgtaaaataggggataataatagttgcccttctccccntactctaattaggcaatgctacacaatcttttt

SEQ ID NO: 2476 - DNA, 474 bp, Homo sapiens
  Genbank Accession No. N29353
  unsure (1)..(474): n = a or c or g or t
caatgtagctatttattatatttttaattggtatttcctaatctgagaaagtccatatattcaacatttatttcgctctaaataatgggataacaattacattaacttttgatttatgttttactggtcatgatggaccgactactataacaagcaaccccaacatttcagtgaattaatacagagtttattgctcatttcaggtcacagttcagtctaataatgtattgggtggaggaagatgggatctgtcctatgcagtcatttanggaatctaggttccttccattgtgtgatattatgatctttaggcgttggcccccaggttcttgtagagaggaacagcagagaggagaagcggaaaggaggccaagaaatattattccgatgttgtaccccagggacacggagaagaacaatgtttgttgatgacattagtgctgtctgctatagtatttttccccaactgattag

SEQ ID NO: 2477 - DNA, 289 bp, Homo sapiens
  Genbank Accession No. N29484
  unsure (1)..(289): n = a or c or g or t
agaggttgataaatgcttttaatccccacattccacacacgggggacgctgtcattcacattttcatatttctgttctggtcgcagtctgtgtcctcaccaccctcatgaatgagggactttgatagatgcctgggtttgtgggctctgcggtactgggaaggagatacacaaagggtcctcggaggagggtgtggganagctttgaaggggacaaccactgcngacacctggaggggagctaaggggaanatcctgagactttaangagacattggaatggcttgggc

SEQ ID NO: 2478 - DNA, 485 bp, Homo sapiens
  Genbank Accession No. N29543
  unsure (1)..(485): n = a or c or g or t
tcagaaattttcaattttattaatattcaatttacgtaacaggctcaaattttattaattgaattctgcatccatacgaatttagtcttaatttataaagcaacttacttcgatactcttccttgaagtatgttataaaatacaacgtttaaataaacatcacaaaaatattgtttgtcgatcatttttgtgactttaacagagaaatcttcaagtttataatccactcattcttgcttacagccagacactacataaatccttaccaaaacaaaacaaacccaggtaggttcactgttacccctaggtatgcttcgttggaattcacccagagaaacccattttccctctaacggagtccaattactttccattctctacaggcatctcaaaaatggactataataatggccatgtggctttggggggactctgggagaaaaatggaacatttaattaaagggcaatagttggttcaaacagng

SEQ ID NO: 2479 - DNA, 394 bp, Homo sapiens
  Genbank Accession No. N29740
ggaaataagtcaaagcattgtttatttatgacatatttacatatttacaaaactgattttactcaatacatcatcctgcgtaatatcataaaatgaacaccatatcctgggaataaaaatccatatttcttaataatttatgtatagcccaacttttagaacatagaatattatcaatttggcttcccaaactacaaagtcctgtttataattttttctagccaaggaacagagtagattcaacagcatattaaagtaatttagttaaccctgagtaattactaacttgcataattttgaatggatcgtatataacacactttcatctgcacttagatacttatactatcacactacctttttgtatttatccacctcaattttcaacttcatt

SEQ ID NO: 2480 - DNA, 399 bp, Homo sapiens
  Genbank Accession No. N29742
cagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcattttttttttttttttgagacaagagtttcactcttgttgcccaaacgagagcaatggcaccatctcgactcactgcaacctctgcctcccaggttcaagcaattctcctgcctcagcctcccaagtagctcgggattacacgcatgcgccaccatgcctggctacttttgtatttttaatagagacagggtttcttcatgttggt

SEQ ID NO: 2481 - DNA, 378 bp, Homo sapiens
  Genbank Accession No. N29764
atctgtaatagtttattttaaagactttacatttacaagtagaaacaacatgtgttatctgtgggtaaggtagagcaggaactctaatccaagggtgggggagatcagttggttccttcacagaaaataagcctgttgtgtgggcatcttgcttgcctgtagatctttgttcccagttcaggaggtttttattcagtgcttgcttcatttactggaaaagttcactgggcccacctgtcaactccttcccccacagcttccagctcagcagcaaactgtagggaacagatttactccccagttcctactgtaaataatgctttaagaacagcattccttttggacagtatgtcatagacccaatttttaatactccca

SEQ ID NO: 2482 - DNA, 271 bp, Homo sapiens
  Genbank Accession No. N29888
ttaaaacacattaaaaactttattgtaagtatcaacatctaaatttgcatcaatttgatacatcgttgctcattttgcagaacataacagttgcacattgcaagagtcaacttgcttcgggtcttttcatgctcatggcggtccacccctgccttccctctccctgacctgcatcctgtcctccacagtctgccctgcctcctgtcgccacaggttgaagacccaagccctgaggagaacctgctgccagggggctggctggctgcgagca

SEQ ID NO: 2483 - DNA, 427 bp, Homo sapiens
  Genbank Accession No. N30436
ctttaatatagaattttatttctggttatagaaacaaatgctaagaggagaaacaaaacttccccatccacatacaacaatttaatagataaaagaacagttaaaataaatgaaaaacaaaaagtagaaattttaaactttgttatagctttaaaacattaacgtctgatacaattagaaatcacattcagatctcaaactcttaaaaaaaagtatggctccttattaaaaaaatactgtatcccacttgaaatgaaaacacaggttgcctgctgttgacatgggtggggctgtcccttcctctggtgtcgtgcgtgccccctcccggtgctggggtgcagccacacccccccgccgggtttctgcacttgtcctggggggacgggggactctggatgggggccacgggcggacccccactccactg

SEQ ID NO: 2484 - DNA, 585 bp, Homo sapiens
  Genbank Accession No. N30856
  unsure (1)..(585): n = a or c or g or t
gattaaaaagagaaaatatactgtaaaatatttatttaataaaaataattttataatctatacagaattgaataaaaagtacaacaaattattttcacttatttacaaaactgcatacagtacaacttgcacattgagttcagcattctataaatatggccacataccaagatgtgaacatattcttgtcttatataagaaaaggctcaggttgtatgccacaaactttgaattaaattccagggaaatattgctttggtaacatgaacaatttgtaccacattccattaaaaaaagatttaataaaatccctcaaacagcacttttctacttgtttcggagtacacaattcccaaattagcacaaacaaaacaaagcaaaaaaagaaaaacagacagaatgtaaaatgnaggttgctacttttatgatatcacttccctttcccttccttagctagtggtcctttcccttcccctaatagtaagggtgggngaatggaaatggcctattcctatccccatccatttgcctccaggatccctgcttaaccnaatgnggtatggtcgncttggccacctgncaccc

SEQ ID NO: 2485 - DNA, 408 bp, Homo sapiens
  Genbank Accession No. N31570
  unsure (1)..(408): n = a or c or g or t
ntgaaaaagaggtgctttttactctagtattccttgttctgggatcacttaatcactatttcgatgatgaaggaactctgaactcctaagcaaaccatgccatgacatactttatatatatgcacaaaagttggataaaacacaaaaccagcattttgacaaattcactttaaaatgttttccacatcaactacttaaaagaagttacagcaatatgatcttccactgctcaggaagacagagtgaacttggatatgatgaatattaaaaacaaacatacagagcacctgggtctggacttgtgggctaaagaaatgcttcctgaatttgtccgaggtgatgtgttgagcaaccgtgccacagttcaccagcagtgacactctagttcttcagtatattcctgttgtg

SEQ ID NO: 2486 - DNA, 412 bp, Homo sapiens
  Genbank Accession No. N31597
gttaaatttttttatattaaaaagtggcatgaactttttatgtagaacaaaaatcttgggaaggcaaaattggataaaaccattaaaacagaaatagagtgcttcaaatgaatcccatcaccttgtgatgtcccttattaacagtctctaaaccaataccagataccagaacagtccatcctaaagaacgagcagcagtccagggcctccacgctacttcatgcaataactgtttaaattaagccagcaggacctgtttcctttgtataagctacaacttctgaagcattacagttcctctagcacggtgctcaatcacagcacttggagcacctctctgcataaaggcaaacaaaacattgcctaaggaccctgcaatgccacccttggagggcttacaaaacagtagtta

SEQ ID NO: 2487 - DNA, 422 bp, Homo sapiens
  Genbank Accession No. N31598
taaagatttttatgtctttcagctttggctattttgtaataaatatcataccttctcacataaacctacttgggtaagaatgatttctctgcacatgcctttttttcttttagcagctgctgagtgtttgttgagtgacgtacaaggcacacctccaagtgttctgtacagcatttttattgatgtacaaaatagcctgttcaccattcaaaaacgtaatctgcatagtaagagtttctcttatccctatttacagagaaggtttttagtgcaaaaacatgaaattgtgtcccagcccaccccttctagcacacgcattgatcagttttgttccatgctggccgggggttatttggctatattttgggcctccagccattaatgaattgcattatcttcttcacctggcaatttgctcaatt

SEQ ID NO: 2488 - DNA, 276 bp, Homo sapiens
  Genbank Accession No. N31741
ttttttttttttttggcgacatagtattttattttcctagaattatgtccagctgtgagaaagccaggttcaaatttaaatcctttaataacctgtcccagaattactaacaatgagacttaaacaaattttgatttgtgaagaaaacatgaaaaaagtccaaaagaaaccccctcaaagggcccgagtgtcaacagttcccctttggagcagctcatccatctctcaggtgggggtcctccggcaggcagcttcctctgtggcgccaggtgggtc

SEQ ID NO: 2489 - DNA, 568 bp, Homo sapiens
  Genbank Accession No. N31952
  unsure (1)..(568): n = a or c or g or t
cagtgaaaatacaactttatattaatcatctcaataatacagattacagaactgagtttacagattacagaacttttcatactttgtgggtcagaaaggataaccgtaaattactgtctccgctttatgggtggtaaaactgagccacagagaaatttctctaagaaaatttaaaaggaattgatgttcattaaataaatatcctcactgatttttttaaggtagaaaagtacaatgcacagtgttaaaaaaattactgtaacagcctcatgttcgagaagtctaaaattttaaggctactacatgtgttaattttcagtacatgtccaacagaaaacatcctttattccagttacatcctgaagataccgaagtcagtcttctctattggtgcgttgagggctgcactaaaactggagacccaagaccagtctggtgtctgctgggatcaatgatcccatcatcccatacccctgcgctgggaatagtaaggggttccctcctcttccaacntcctaatggatggggcccttttaaagccgcttcatcagcactggggnactgcttt

SEQ ID NO: 2490 - DNA, 363 bp, Homo sapiens
  Genbank Accession No. N32071
  unsure (1)..(363): n = a or c or g or t
catttaggaaattgcatttattgggttaagttcaccctgctattcccagccctcatgctataatgatctttccttttgcaaaggaataacacagagcaaggaagtctgctgaaacttctgagatcctcagaaatcaagagaaaccacagtcgcttttctccgatctccatccacagtgttggagaggatttttcagcaccattccgagacctggaaagggtgatgaactgctttgatttttctacttctccatacatttggccaaaaaggagcaatcctcctggctagaaaaggggcatgtcctgctttttctctgaaatcacaatattagcagagtgggttcagttccctngtgcccacngt

SEQ ID NO: 2491 - DNA, 478 bp, Homo sapiens
  Genbank Accession No. N33009
  unsure (1)..(478): n = a or c or g or t
gcgaccgacacgtcctccatgtccgcgcccagccggnctcgcgccgcctgcagctccttggacagccgtgcccgcgtctcctccgccaccggggtcagttgttcctccagttccgatttgtaggccttcaactccttcatggtctcgtccatcagcgccctcagttcctgggtgacctgggagctcgagcagctcctcctgcacctgctcagacagtgtctgcacccagcgcaggtaatcccaaaagcgacccagtgccagttcccagcgctggccgctctgccactcggtctgctggcgcagtcgnggctccggctctgtctccaccgcttgctccaccttggcctggcatcctgccaggaatgtgaccagcaacgcagcccacagaaccttcatcttcctgcctgtgattggccagtcggctcctggggaaggacgtccttcaacctcgtgccgaattcttggcctcgaaggcaaa

SEQ ID NO: 2492 - DNA, 466 bp, Homo sapiens
  Genbank Accession No. N33920
atcaaagaaacatagagttcgggcaatatacttcatcctacccatcccacccaaatcttactctactcatctcattctcattaattttgggaaatcatcagaagatgtgttcgttgagtaagagattaaaagaaataagctttttgacccctgccaacaccccatgcccagggtggtcaccctccaatacaataacatgccaggaagagtaagttgccctttctgatgccgtaatctgccatcatcttcccatcttccagtctcctttccattgcaagtcacaatctgggtctcagggattatacccgtcttagtctcgatcattgctttcacttgtgccactgagctggaccttcgcacctgggaggaggtgcctctttgcctcatcacctgactccacaagaaacaagggcagctcctcatcactggggcttcaccactttcaggggtaaggtgggatggtctt

SEQ ID NO: 2493 - DNA, 360 bp, Homo sapiens
  Genbank Accession No. N34017
  unsure (1)..(360): n = a or c or g or t
ttgataacaatgatgaggtttatttttgtcaaaacatccaagggaaacattaattgttgtttgtcaactgtgaacttcacactacattgtctaaggatagaaaattgatgggtatcactcngtcagaaaatcctcaccaagaagccaattcaaggaatatgaaattgacaagcctttcaaacanaagatgtgttcggacttcactgatgcgatggtaggtcttttgggttacaantagatagggatgatataaaacacaatcttttcctgtctattccattttagaaaccggtgggngtgcacacgtttagtctgggcattgcagcacngcacaacatacatgnattaaagcnaagcata

SEQ ID NO: 2494 - DNA, 510 bp, Homo sapiens
  Genbank Accession No. N34257
  unsure (1)..(510): n = a or c or g or t
accttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggnacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagttg

SEQ ID NO: 2495 - DNA, 465 bp, Homo sapiens
  Genbank Accession No. N34441
  unsure (1)..(465): n = a or c or g or t
gagggtttttactttttatttggaaataagacatggaagttgcaaagatagactactcctatgtattcctccaactttccccaatgataatatctcacacaaccatagattatcaaaaccagaaaactgaccaggcacagtggtgtgcacttatagtcccagctactcaggtggctgaggtgggaagatcccttgagttcaggagttcaaggccagcctgggcaacacagtgagaccctggctctataaacaaaaatggnagaaaaccagaaaactggtgtcatcaattgtgtttaaggaaaccgaggctcctttaaaagtttgttataaaattatagatatctcctaaatattgaggtggaaagattcccctgggaagcagcctagtccagaaagttgaagacagtgacatcccagataggttaatacttctggccagcaccataattacacccctccttnggt

SEQ ID NO: 2496 - DNA, 503 bp, Homo sapiens
  Genbank Accession No. N34804
aaagaattaccataagttttatttttgcttagttttattaaaaaaataaatatgtcataaagctttctttttccttagggagaaaaaaaggaacaagtctcataaacccaaataagcaatggtaaggtgtcttaacttgaaaaagattaggagtcactggtttacaagttataattgaatgaaagaactgtaacagccacagttggccatttcatgccaatggagcaaacaacaggattaactagggcaaaataaataagtgtgtggaagccctgataagtgcttaataaacagactgattcactgagacatcagtacagatacatcttgcttaaacaacacagaagttcctgaaaagttttgtgtaaatgatataaccacaaacattaccaggagagcttgggtaactgaaagaattccatggcgaattcctttggtgaacaactactttcacttttggtaaatccaggtatttgctttttataaggagtttacctagttgc

SEQ ID NO: 2497 - DNA, 455 bp, Homo sapiens
  Genbank Accession No. N34825
  unsure (1)..(455): n = a or c or g or t
gacattataatgtagttagtgttttatttcagtgcagttagcacatgggtatggtttatctagagttacagactttgtaaggtttgcagctcagggcagttcttcaccgttggcaaaagttgaatccggcgagggctgggaattcacctgccctccactttcagctgcctttgggttagttttgtctgctgctcttcaatgaccgtgtcacctgttggcttcagtcacaccagctctgaccacatgctgggatctgggctggaacctgggccctgctgaggtctcagtatccgtggcagctcagggctcttgtaaatgtatttgtgcctgtagccaaggtctgaatgaaagggcacaaactgaactttgaagtctcggaagcttcgagctggtgcngcgatgctatagagctttctgccaagctggaaggggaccaccgggtccgtcctcagcgt

SEQ ID NO: 2498 - DNA, 302 bp, Homo sapiens
  Genbank Accession No. N34919
gcatagccaatcttttcatttttattgctttaacacacattttaattttcagttgaacaaattcttaatgagctacagagtgacatgagttgaaattagaataaagtaaaataatactatataaccaaaacaaacccagtgttacatatgtgaaataatgcaattaagagcacaactaaaaaaaatcattgattcagttaaacacaaaagacatgcagggtctcaaacaaggagtatttgggcttctatgtcaatgtcataggaaagagctttttctatttctggataaatatttcattttt

SEQ ID NO: 2499 - DNA, 474 bp, Homo sapiens
  Genbank Accession No. N35247
  unsure (1)..(474): n = a or c or g or t
agtaatttacaattttaaaaaacagccacaaaaaagtcaaagctaaaaacaagatttttactatgaatcagtgcttctattatccttctgaaagaagttatattttaatgtgatgtaaaggcaacattgaaatttcttctttaaattaaccacctaatttatccctaaaattacaaagaatcagtcttttacaggtcaagtgcagtaaactaaaatgttctctcagcacaaagcagcactagaaaaagtaacagttatagatgggagttgactagttttgcagtggctgcgcatcaataacaaacagacatcagacggtatccatcccagagcacagacactactacagactagatgcgaagaatgcgtcacactcttggctgataaatgtcctttgtctttgactctttctagtttgaatgaagtggattttttaaaagtttaaatcaggtcacataagttgggctgcntaaa

SEQ ID NO: 2500 - DNA, 439 bp, Homo sapiens
  Genbank Accession No. N35376
gaataaaggcatatttaataaattagggaacatcttaacttctaatagactgggggaaatttttaagttttctatgtacacaaaggcagtgggaacaaatgaaaaaaacaaattactacattgttgcagcacattaaagactggatggtgtatattattcacaattacatcctctttcccatagcctggcagaggaaagtagttaccaagcacaggaacaatttcaacatctcactggagtctccaaaagcaagcagatactgcaggatgtcattaagcaacttactgtcacttcacaccatatgtggcagtaagaaacttaaaaaaaaaattaaaaggcacgcataagctgatttcaaatattttaagtccaggctactctctttagatacaatgttttgaacacttgtatagaacagtttttaaataaacatttcca

SEQ ID NO: 2501 - DNA, 423 bp, Homo sapiens
  Genbank Accession No. N35493
  unsure (1)..(414): n = a or c or g or t
gttaaacattttatttatgtggcactctgaaacgagcaacctatgaaggcataaaataaaaagattttttttttaactcgggaggtaaagctagatatatcaattaggaactgattcatggtgtgatgtacacgacatgttgaaagaatgccaaaaaggcgcaaaccatcatacattaatacaaaggacaaaaacaaaaaaaaccccagcatcttcttgctatgaggcaataaggcactgctaagagacttnagcaccaaaatgattctctacaaattccttcctttttatactgcaaatactgcattattatattcaaacctttaaaaactaggtaatacttaagatttagagtcaacttactttgtgggaaattctatttgctgcttcttttaaaaacagattaaaataagctcttaaaaa

SEQ ID NO: 2502 - DNA, 337 bp, Homo sapiens
  Genbank Accession No. N35913
aaggccgtatctttttattagacttgctcatcttctagtcaccccttgtggtagagcgaaaagagtgtgttgtccctctcatgcctctggtggtcacaggacactgagtaaagcaagagactggatactttcccatgtagaacctataccccaatcccgactattgggctgggaaccctgtctatgcccattcaaagctcaccatgtgggaggactgcttgggcctgggaggttgaggctgcagtgagctgtgattacaccactgcactccagcctgggtgacagagaccctgtctccaacaaaacaaagcagaacgctcaccatggttctgagtta

SEQ ID NO: 2503 - DNA, 412 bp, Homo sapiens
  Genbank Accession No. N36001
  unsure (1)..(412): n = a or c or g or t
attagtgaattagtttatttaaaaccatcagtttttccaatgtgaatggactggttcatatcacaccatatttagagatacaaggtgattataactaacgtgtctacaagacatactgggtcaaacaatgtgatcaatccaaagggtatctttttaaaaagaatttaagtactcagctgcaaagataagttcactaatgagattttcttttttttttttttaaaaaaaaaaggtttttaatgagtcaaatttattacaaaaacttagtgtgtaatcaaagccaaatacattcctcaggcatgccagcggaacgcaaaataatgttaatagaatgttattaaaaaataaaactttttctgaatgatatatataanacctcatggcacattatcctcatttggacaacnggaaa

SEQ ID NO: 2504 - DNA, 506 bp, Homo sapiens
  Genbank Accession No. N36085
ttacttgatatcaaattgacatttatttaaaaaagggaaaaaaaagacgtagaacagaattcacacagacctttgttattccaagctcctatttatgaatggtgattaatagcaataattctgtctctcttctctctgtgaaatgctaacacttgctaaaggcactcagattctgggcttaacggagacaaggtcacatgggaccataagccagtacgttttttggtagctacccagaaaggaagtttacaaatgttcctcccattcataacgggaagaaaaagtcaaacagctatcagtagaagcgttttatgagaagctatttacacagctatttgtccattcagccagagtgacagtaactgctcacaatggtaggggttctcccctgccaagaaagcaaaaacaataacaaaacactttttatcatatatgaaactcctgtacaatgatttgggctagaagaaaaaaatagttggtaaggtcaaatttgttttaaaacatct

SEQ ID NO: 2505 - DNA, 407 bp, Homo sapiens
  Genbank Accession No. N36250
cattaaaataattcttttaattattgatgctttgaataagaagtccattttactaaatttagtataaattatttttcttaaacagaacctgtttgctggatctcagttaagttcactttgcagttttcagacacaatgactcatattcaacttttctctttaaggattcagtggcttgattcctgacatttcctctttaagaggaatcttatgtcatcttctgaaatcatgtatatgggtaataatattaagtgtcttctcttctgaagatgtgattcttttaatgccatgttctcttccctctggtgacctgacttagattgtagcagcactagaagctattaagagatttggggcagttgaggaagccttaggtaattgttaagagtaagaagtatttttaaaaa

SEQ ID NO: 2506 - DNA, 621 bp, Homo sapiens
  Genbank Accession No. N36432
  unsure (1)..(621): n = a or c or g or t
gaacgcacaggccgtcgctatgagcggnaaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcaacctgggcccgtgcagntccagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaaacctttgcctatattaggttgtacttatgtacatattttgccagtgtttcacaggagaaagtggncttaactgccccttattccccntccaagttggnaaaaaaacatgtgtttaaancaaagttaaactaatgtttgaaaacccagaaanttgaacccg

SEQ ID NO: 2507 - DNA, 458 bp, Homo sapiens
  Genbank Accession No. N39099
  unsure (1)..(458): n = a or c or g or t
tgaaaaacaaaatacctttatttagttaacactgaatttgcaaacacagaaaggaatagaaaacctgactccacttggacgcacaggcctttggggagttctgacaccagggccccatcggcagctccaccagagcatcctggctgcacctccttcccggagtcctnggcttgcctacctattccatgggaggttggcctggatgtgtcaagggggcctttcagctctagtaaagacatctgtctccacatccaaggagctttgcaaaagacacgtggcaggacaggagactggacgcactgtggcctggggaaggcagcggggcttgggcctgnggctgctccccttgggagaaactgtgtggctgaggcaccttgttatggggtggggcctgggcttggacacagctgcaggctgccctgtcctccaagaggagaggcggggcttgaaagatttga

SEQ ID NO: 2508 - DNA, 544 bp, Homo sapiens
  Genbank Accession No. N39163
  unsure (1)..(544): n = a or c or g or t
agtctagatgaatttattgccattcacatatttcataagaaaaaaagatgtagcaaacgggtcagggttgtacaaaaaaaaaaaaaaaaaaatccaggtttatataggttgctctatttacatctgagagcacagctgtcctgggcatcaggcacagcagctgcacttgtctgacgtccctttgcagatgcagccctggnacacttggcacagccacagggngccaggagcagcagcctggagaagaaggggagagtgagaggtcagagcagactcaatcaggcacctccctgccccaacagaggcctggctcgagccctgcctccagccccagaggaccatcatttcaggattggcatggntttgtcagaagagaactgggtagatctttgggatgagggttttatatgaaaaagctgnccagccccacctgagtntggggacaggacagaagattggaaanggagttanttgggggtaaangaaaaaaaggnggccagtttccccaaacctatcctttaatggagggaagttcttcanagcc

SEQ ID NO: 2509 - DNA, 547 bp, Homo sapiens
  Genbank Accession No. N39201
  unsure (1)..(547): n = a or c or g or t
catggcatcgtgttgtttactcggtacaaccagcctgttgtgaaaagggcccgccccctttccagaggcagaaacttgctccaagaggtcggatgctctgccagaggtgcacagcaccagggtgtggaatgtccaggccctgccatctcagtgcccctccccgctccccaccggccagcacctgctgtcctggactcctggaccttcggtgtcatccttgtccccaactctaaacacagagctactcactcccagccctcccctgccacatcctcctgcttggaacagatgagcagccctgggaggntaatnggtttcgtggggtcgacgactttgcccagaaagaggacactctgggtgctggtggaaaagatcaccacaaggaagggccggttgaatcgcaggatgtggcgattggtctgggcagagaagaatttgatcgcgactgggtggctgctgnagcctcggtgccagcctcatccacgtccaaggtggccttgtggaacttttggatgcctccagttttgctgtttggtgatgccggata

SEQ ID NO: 2510 - DNA, 445 bp, Homo sapiens
  Genbank Accession No. N39237
  unsure (1)..(445): n = a or c or g or t
gaaagtttaaagatcaggagattttatttaaaagctcagatgttcaatttctcatgagaaatcagaagatctggtgtntctgggcccacattctgcctgtccgctgtggactggagtggaggacagctgcccttccagcggggcccatccaggtgtttgacccaggtgctatacccgccagtccctgacagcagttggctttttgctcttagtacctgtatctgcatcctaaatttgccacgacaaactaccacaaacttaaaacagcagaagtgtattctctcctggttctcaaggccagaagttagaaattaaggtgtcggcagggtcacgcttcctccaaaggctctagagagaatcagtccttgaccgtcccagtttctggagtcgctaggcattcggtggcttgtggcagcataactccagcctctgcctccatctgcat

SEQ ID NO: 2511 - DNA, 330 bp, Homo sapiens
  Genbank Accession No. N39254
  unsure (1)..(330): n = a or c or g or t
cataatacttttttttattacaatatccaaaaaactgggtatgcaagtttaggggatctcaagaccccttcttcaatcgtaggaatgtgccatctcaagacgttatatttaaactataaagaagttcaaatgtaaaggnaaaagaaaatgcaatttcttcagaaacattctgtgtgtcncttactaccantcacatactcntttgtaaaccctgaaaaatttccctgtnaataatatatancctatatagtgtgtgtgtgtgtgtgtgtgtgtgcacgtgtgtgtgtgtataaagtgttggtagctcccttccccaaagatcagcngttt

SEQ ID NO: 2512 - DNA, 236 bp, Homo sapiens
  Genbank Accession No. N40188
  unsure (1)..(236): n = a or c or g or t
tgcttcccatattgatcctttatattcctaaatttattacaattttaactangagatcatgaaggtaaattgtttcataaaactaaaaccaatgtatacacataataacttgagtatttcctggtttgtagcgaccatcgatagcagggtatcncaaaatgngcactgatgacatttggacncaataatnctttgttgtagaaagttataagatatatatattttaaactatgcta

SEQ ID NO: 2513 - DNA, 493 bp, Homo sapiens
  Genbank Accession No. N40320
  unsure (1)..(493): n = a or c or g or t
cctggattaaaaggatgatttttaagctctttagtcaagagacggtgatgaagtttgtgccgcggtacagcctcgtcctagaactcagcgacagantagccttccggagaagcctgcatgatcccgatgggctggtggccacctacatcagcgaggtgcacgaacacgatgggcacctgtacctgggctctttcaggtcccccttcctctgcngactcagcctccagntgtnttagccctcccagatagctgcccctgccacgcagcacaggagtcttcacactcaggcaccaggcctggtccaggaggagctgtggacacagtcgtggttcaagtgtccacatgcacctgttagtccctggagaggtggtnggaatggctgcttcattcctcgaggatgcccgggccccaactgggcttggtctttcctggttagagggaaagtgtaacatatctgccatgangaacataaattcatgtaaagccattttca

SEQ ID NO: 2514 - DNA, 451 bp, Homo sapiens
  Genbank Accession No. N42272
  unsure (1)..(451): n = a or c or g or t
tacatatttcccgggataagatcaccaggccaggagcgacnatnggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaattttnttatctaatgatcatcatgaaatgaataagagggcttaagaatttgtccatttgcattcggaaaagaatggcccagcaaaaaggtttactaatacctcctcccctttggt

SEQ ID NO: 2515 - DNA, 575 bp, Homo sapiens
  Genbank Accession No. N45224
  unsure (1)..(575): n = a or c or g or t
gacggtcttcaggtttatttcttaaatcaattaggaaataaaaccacagtgcccaggaaagttcacatgagacgccacggtgtctcttgccatggccccaccactccaggggccagggggtgctgctggagggaggacagacggacaggcggcctgggttggcggccccagaaaggctggcgtggatgttcgagatgagccaccagcgaaccagtagggatgtctgggccgtcctggtgggattgtctgggacatcgccaccaacacggtgtcagagccatcagtggggacatcggaggggccaccaccaggtggggtatattcaacaggctagaacccctgaggcttgagaggccaacccccggcaggagacctcccctgacccctctgctgcctctcctgtgggaccctccagtagacacaccagatgaggacacccaggaggcctcctcccaggacaggaggcagctggctgggcagccacgcattcagggttcagggccctccagcangagctccatggagatggctaatggggacatcaagcaggggctacagtggtacatccagtggtc

SEQ ID NO: 2516 - DNA, 687 bp, Homo sapiens
  Genbank Accession No. N45232
  unsure (1)..(687): n = a or c or g or t
tgcaaaccaaaccaaatcattttattgtgcaatttccttctaccagaaaattactaaaaatataaatattaactctctaaaaaatactcagaatagatctgtaatcttcctcctcctcctcagaactggagccaatcttcttctttaaacctgatggattgcatacatgtatgtcttccatatcagccacatacacaacattcagatacacttccgtctgtgcagggggatacaccagcctcctgccaggttctggaagctcaccttataatctaccaggataaagctgtgtgctgagtaggaggttatggtggggttggggagtaacaaggagataaaagaccttgtggtcccaacttccttatgtggacagagaagataggtcctttactcctcctcattaccctgncctctcatggactgggctaactgaaggccaagctcccagagaagctggactcactgtgcgggattactgagggtgtggctgccaggctacagtcacaggaaggncagactgttgagatggacatggaaaccaggtgaggctttggatggnaagctggtctggggcaaagctctgcaggatgagtagtagctgttccggcgggntttgggnagccccagaccctagcaccaggtactatgtgcagcatctaagaccagnaccagtctccaagagccccc

SEQ ID NO: 2517 - DNA, 412 bp, Homo sapiens
  Genbank Accession No. N45307
  unsure (1)..(412): n = a or c or g or t
tgcacggcngataggcttttattacagactgngggcgntaacngctggacagagaacggaaaaggaacatctnagaccaggctcaangctnnggggttacacaacctccaataacacaaggtgagtgcagcacttctagacacacacacagacacacatcacttactcataaacggcacagctacggtacaagaaaaagggcaaggtaggtaagggcacccaacaccctcctgcctgcaggggccacagggttaatgtgccttcctgcacgcaggcttaagagggataaacaaggagagggctgcccttggagaaggcctgcggataatagtgactgaggcacaggtccatgcaggggaaggaagcacagttcacagagtnggcaagctcaatggccagccatttgccaagc

SEQ ID NO: 2518 - DNA, 529 bp, Homo sapiens
  Genbank Accession No. N45320
  unsure (1)..(529): n = a or c or g or t
gttataagctttttcttttttagaatttaagcttatgagtttatctacgcccactatattcataattacagttttatatctgcatacaaaagctatgtaaaaatccatttttcccaaatatacaaattttttttggatagtttaaaacattttcgatcacagatttcaacagagttttaggctgaaaaaaatatcaccatctagcaatatcacttaacactgtttgcaaaacacaaatcttccaatgactgtaaatctttttctattctgtagtatttttctgattctcagggcatgaaaacattatgggaaaaaaaaggattttctacgaagaaagcatggagaactaatttggctctatggtcaaattaaaaatgccaagttaataagggagaaccaaaagaaagaagtggcataatgtcacatcagctcattcatgcccggataatttctgtatcaacaatacatatgtaaagtggtcnccttttggnctacattggggcnccctaattnccatgngtattancgg

SEQ ID NO: 2519 - DNA, 389 bp, Homo sapiens
  Genbank Accession No. N45998
acaaatatttgaatttttatttaatttacagcaaagaaccaggtgcaatcaacactttcatataggacaaacataaagtatttcttgagctaacagttagccttcacttttaaaagtaaaaccagaacttttattcatctttctttctgcttcagaaattaacagctgctcattaaatattcattgatgcttgttgtaattgtactgtatttcactaaataaatgtttataacacatttaaccacaaaatagatatcacctctaagtttaacttatattcatactaaaatgtagtattaatttttcaaagatttttatgatgggcctagagaggaaggtaaattatgtagatggcatatcttcccataaacttagtgcatacctagaat

SEQ ID NO: 2520 - DNA, 423 bp, Homo sapiens
  Genbank Accession No. N46423
  unsure (1)..(423): n = a or c or g or t
acaagactttgtttattaataaagtaattcattatgacttttgaaaaaaaaagttttaaaatgttctgtgtacatgtcaatgtaggttaggccagccaaaagacaaagcaaagcatcaacattaagtcacaggctaggattatacaaataagaacaaacacaaggcttatggtacttgttaggtaaacacaaccaaactaaactgtacttcaaatttgtttatataaaagcatattaaagctcactttaaaatagtgtccatcttttcttttaaacgggcatagactcatttgcagtcatgtacaaatatacctaatnagctttcttcatcttttaatacaagtacaattccttggcttctttatgcaacctaacaaaataatatagaatggaagtcattagaaaaatatggacccttctgga

SEQ ID NO: 2521 - DNA, 447 bp, Homo sapiens
  Genbank Accession No. N47469
  unsure (1)..(447): n = a or c or g or t
gtgattaacaggacttttattggtagtaaactagagcaaacaatcagaataatacatatgcagtattcagtacacacaataaaagttaaagaaattcaaaacctgtataaaacaaactggagaaaaatcatacagcttaagagatacagtggtaaaggtcctctccatcctttgattacagcttgtactctgtactcaatagaacttaccgcacttactgaaataagaaataaacactttttagtactcagcgtatttaagattaagtacattttctaagaatcttgcaatgacaagttggtgaccctttagctgctaaagctaaagggaggaaagtgggaaaaggaaattaactaatactttgtaaccatttttaatatttcntattttccaaacactgcttttataacagaagtgttttacacttggcacaatattaattacttg

SEQ ID NO: 2522 - DNA, 463 bp, Homo sapiens
  Genbank Accession No. N47942
tggtttattgtacatgctttattaaaatggtacttgtatttacagtatctgcagaaagagtcccttccaaggcctcacacattcagacacatccatactgacacccactccacagccccatgcacccacaccagtgagatgtggagggtcagactcctaaaattaggcagctgttggggataagagttgatttgtttttcaatttttttgaaaacagaaaagcatgggggaatgcatttggccattacaatgctaattgagtttgtgtatattacatatatggcagttaacactgtaatattccttttacattctatatacacagaatgatatcaaggttttatggtcaacagaatattccaacttcagtcttaatgctgcttgtagtgatttctgaattcattataggggctttccctaaaaataattcaagtctatgttaagtgaaataaggcacaattaa

SEQ ID NO: 2523 - DNA, 454 bp, Homo sapiens
  Genbank Accession No. N47956
aaaatcaaatgagcaagcagtcaagattttgttttattttattatggctagaaagacactgttatagccaaaatcggcaatgacactaaagaaatcctctgtgcttttcaatatgcaaatatatttcttccaagagttgccctggtgtgacttcaagagttcatgttaacttcttttctggaaacttccttttcttagttgttgtattcttgaagagcctgggccatgaagagcttgcctaagttttgggcagtgaactccttgatgttctggcagtaagtgtttatctggcctgcaatgagcagcgagtccatcctggcaggcggctgtggtggtttgaagagtttggacaggtcctcctcagggagcgggggttctcctcggctctggcgctgcatattctcctgctggcgacgctggctgatactgatgtttccgctgctgttgtttacta

SEQ ID NO: 2524 - DNA, 347 bp, Homo sapiens
  Genbank Accession No. N48155
tttttttttttaaggacctttcacaaaccaaatgacagcaggtttttattaacatatcttacaatgttgattattcctagttttgtaatttctgcttaattataaagatcaatttagcttctacagtaatgtactgtatttaaatcgatcattcatacaagatatcacaccagtacatttttttgaataatatacacacatcactctaacttggacctgttatttttaaaagtgggtttataaatgggacttataaaagttatggggaaaaattaaagttctagtttagcagcatgcatgtatgtattcaagtacaattttcaaccaagtgcttttttaaaatttac

SEQ ID NO: 2525 - DNA, 397 bp, Homo sapiens
  Genbank Accession No. N48180
gcatttgaaaagctaagaacagcctttattggagaaagtaggataaagacatttccatatatgttcatgggaatttaccattcaaatttaccattcaaactgggggagtagagatcagtcacttttgccatcttatctgtttaaaactctttcaagaaaagaaaagaaaagaaaggaggagtctctttcaagaaaagaaaaaaaggaatactgtgtaagaaccacagaaaaaaagctaagtaggagcagatgtgggtgctctttccttaacagtcagcatagaatgtagagactgacattttctttaagaacagattattataactaagcaagaaaaagtatgtgtacataagttggtcacagtgacacttggtaggaaaatataagtagctgtaaa

SEQ ID NO: 2526 - DNA, 587 bp, Homo sapiens
  Genbank Accession No. N48315
  unsure (1)..(587): n = a or c or g or t
tcaaataatccatctaacagccatgagaccactcaagtatttgaggtcatcagctgcgtccatcaagacatgatattgaacatggacaccatctggtctgttggtctgtttttgttggcaaaggactccaaaaggatgcagttgtatgtgtttcagctgaaccacataccatagctcctctcccctcacaaaagggtttctctggggggagaaaagtaactgattatacctctcatgtctcaaactgaaattctgagaagcaaatggtcagttgagggccccattccagatctgccgggacgtcctcagatgtccagagctggcaaaaggtggagcaggcagcagctttgggcaccagcctgtctctttctgttctgataaggccacacacatggctttttgtgataagcttccagcccatgccactgaaataacgtttaagaacctggctgcatttcacagaaatagcgtaatgggaaatcattatgtaattaaacaaagcatgaagctcattatccttttccttttaacaaaccttcaatttcacattttagtggacactgtggnttccagagaatatatggatt

SEQ ID NO: 2527 - DNA, 469 bp, Homo sapiens
  Genbank Accession No. N48595
atgtaaaactgacttttattacaattaaaaaagaacaaagacaatttgataagtgcctttaattacaacatacctgctatttacatgtaatcatacttttatatatagcttgaataagttttattacatgtaaactataagatattacaagttaaactccagtcttttctggatattcaattgaaatactactggcagaaacatacagaaaacaaatacccatttcagttcctcaggtaccattactggttgaatgatcaagatctggccacagaagagaagtggaaatatgcatcaaaacaaaacttattcttaacatgactaacagtattgttatttaaaccctaaacataattaataattggatcattaaaaacacaacttcaatttatatagcacctttcttccgaagagttgaaagcattcgtgcttatctctattatttcgtttgtccccataacatctctat

SEQ ID NO: 2528 - DNA, 422 bp, Homo sapiens
  Genbank Accession No. N48602
  unsure (1)..(422): n = a or c or g or t
tttttttttttttacaaaaaaatttttattaagtacagtttcaaatttagagcttccacgcttacaaatgtgattggatatttaggatacataatttattcttaaaatacacaacttatatacagatattaaaaactcagtctccaaaatgctcaataaagatgtctgggtgacacttatagaattgacctagcaattttttcttctctttggcagaaagttttgaatcctcatcaagagtttttagtaaattcaacagctcatctttggttgtcttcnctgtattgttggaatagtcacgttgatcaattcnctggcaataaatatatcctgcatctcnatttggatctcttccgttctgtatggccataagcttaacacttacaattttatgtagagttccaggnatcttaaaaacatct

SEQ ID NO: 2529 - DNA, 416 bp, Homo sapiens
  Genbank Accession No. N48674
ttttcattggcaattttattttttaaaaatgaaatattcaaagtacttttctttcaaatatcaacacataatgtttaactttaaatatttacagcatgttgttgtgatgctcttgtagaaaaatgcatgcttctggcctgaaagccagagcaaaatgcaaaagaccatttaactgcagccagagaacatgaacctgtacagtatccagtcacttttcagcacaggagagcaggaatacaaaattggaacctattgtttcctagcaacatggctcagaccattataacacaattttcaatatgattagaacctctacctgttgttatacagaaactgaaaacttggcatacactgtaaacatctttacttttcatgagaaagtaagcagctaaaaagaatggtttttccggacataa

SEQ ID NO: 2530 - DNA, 481 bp, Homo sapiens
  Genbank Accession No. N48787
  unsure (1)..(481): n = a or c or g or t
agattgtaaaagtttattgatatggtcaaaaagcaaacagccagacatttggttatctttgccactacaatgtgtcattctgaactgtatcttaaaaatgcataacaaatgatatttaaaccattaccagaaaagtaaatgaagagtctacttaaggcacttcatatgaaagctaattcaaaattttcacaaaagtcacactattttataagtgtagtaaattaccttctacacattttagccagaatgctgcctttctccttacagaagaatgtgctcttaaagggagaaaaagcaaatacaaaaaattgtcattctgtcaatgttcatcgacaaattatctggaactatacagattacatggcagtagtattcccgtggtcaatctgtacaaatcaggggcatcttcatacaagtctcataagaaccacagcatagatttggnctggagaccaggtaccagaatagcaggtaagggaat

SEQ ID NO: 2531 - DNA, 455 bp, Homo sapiens
  Genbank Accession No. N48790
tttttttttttttttttttcagtatatgaaaattcatttatttagtgaaaccctgacattaaagcgtcccaacacaaagcagattcgaacataacaactggtgattggctcatctcacaggctcacatcatcagtgtgttaacatacaataggactgtacccttttacaggattgagtgttttggatcccactcacacactaaaaccctgccataaagttgtatcaattagggctgttcaaatgtgaaactgtattggaaaatgggaaactttatctccttatatatgcatattttttgagatggcgttctgctcctttgcccaggctgggagtgaagtggcacgatcccgggtcactgcaacctctgcctcccgggttcgagcaattctcctgcctcagccccccaagcagctgggaccacagatgcctgccaccacgcccggttaattttttt

SEQ ID NO: 2532 - DNA, 432 bp, Homo sapiens
  Genbank Accession No. N49090
  unsure (1)..(432): n = a or c or g or t
cnntcaataaaaaggtttattaaaaattctgtgaaatcaagattcaacttgactttctacaagagtcagttgagatctaatgacaaaaaaagactgaaagtggtgagatggaagtagaaatttaatgtaaatattaaccaaattagagcagaagagctcaaaataatattacacaagctacatcttaagtaaaaaactgtcatattttataaaatgtactttaagtcaaaacttcaaacagacaaaaaaggacatttaacaatacatagattcattccctgtgaatgtatgacaaatttgtttatacatgcatgtatttgtgtgtngcgtctcaaattaggctttcagatatataaagtaaatactaacaaaactgaataaacacagagagagcaatataatnatagtaggntattttccataccccccctt

SEQ ID NO: 2533 - DNA, 433 bp, Homo sapiens
  Genbank Accession No. N49104
aaagtggttgacgattaaaaaaaattctttaagaccgaatcaaagcacattctttcacaaagcttaaaccacagacgtcatgtccagaaatggaatactgtcatgttaggatgaacatctgatctgatttgttaagacattttgccaaatgcacagatgcacagggtcccccatgcacttttcatgcagcaggtaatcacaacttaaataaaaggtttattctatacatttgtccagacttgcaactgtatacatacatgcacaacttttaaacctgtctgattatatttacacttatacatggaatatacaggaaccaaagagattaaaaggcttttctgttgcattagaacaatacaaaatatgtatttttcattaaggaaatcactatttacatcacctttaaaaaccgattttaacatcttcatggtaa

SEQ ID NO: 2534 - DNA, 203 bp, Homo sapiens
  Genbank Accession No. N49113
tttcttttttatttagccactctcatttcataggcaaagcaagtccaattacatttcatgttatagcaattatctatgtatgttttcctcactccattaaaatttcaccttttccccgacccacattctgcagtgaattcagatctattttccatttttttctcacattatttatatagctacactatcacttccacttcctt

SEQ ID NO: 2535 - DNA, 424 bp, Homo sapiens
  Genbank Accession No. N49214
tcttcaagaccagattagtattttatttttcccttcctaacactcaaattcatggcaggtgaaaagataatagaacataatcaaactaacatataaacacaattcaaaaacgtttaaccatctattatagctctttgttgtaaaacacacaaagttaaacagaaacatctttatataaattatccttaataatctgtatacactgtaaaacaattgaaaattcacaccaagatcctagtgcaagcagtggtgtacaaaagtgcaaacaaggttagtgattaacaacttaccatcaatataccacttcaacatactttacattcagccaaatactgaaggtttcaccatgggaaaaacacttttatcacttttaaagtaacttggactatgttcaccctggagtggctcttgcctcagtatgggc

SEQ ID NO: 2536 - DNA, 429 bp, Homo sapiens
  Genbank Accession No. N49284
  unsure (1)..(429): n = a or c or g or t
aaaataagggcacatctttattttgctacaaggcagtaagtacaccgtcatatctcaaaagttcagtgctggccatcttgcatcaaatgttcttaaggcagtgactggctatcaaccacagtttctgtctccccagttgcaaacacaggatccatgcaacagttctgagaccatacacttagaaaccacaggggatgcggatcaaatgcagaactcccaaattataaaacagtcaggctacactcaaaacaaaacatagaacatcaacaacacacatctcccaaaaaagaagtgcaacgcatgcttggtattaaacccaacaattaaccaaaaaaaaccacaattaaaaaaatggcagaggtctccccaaaaccaangtttttccaaatggtattggcagaaggggaaaaaaaaatggtatttttatat

SEQ ID NO: 2537 - DNA, 447 bp, Homo sapiens
  Genbank Accession No. N49595
actgtgttttacatatttattaaagaatccattctttctgataatactcctaacacaggtgaagatatttttacaatattttaccaaactcctaatagaaaatgtctaatcagttcatccttttagtccctgaatccatgtttgagcattttaaagatggaagaaacctgtaagactcatatcattttaaaaaaattgacttaaaacacttattggataactaatacatttgtaacagcatcatgatttgttttgctatctgtatttcacccagaactgctgaattacagaatgaaactcaaatgaaagcattcatctataatttcaaaaattattatttgaaatttttaaatcaatagtcataacatcatcgtgttccgaaattagaaaattattagcacatatacaaacatatttacctatgtcaattaggtcaatgtcaggatt

SEQ ID NO: 2538 - DNA, 392 bp, Homo sapiens
  Genbank Accession No. N49738
aaaccttaaatgtaatctttaatgaaaagatataagcattataaaagaaggggtcataatgagtgatgtggagatggctacatatactttcttaagaatgccacatcttttatcatacagatttcaaatgctttttggctacataagtactttaaaagaattgagctacatcaattaaataacaaatataattagttcttcatcatcacaataagataacaatgattaaaatgttttacctcatatggtgaaaatactaatcttttcattcacaaatttgtaggcaaatgtgtaattaccaaacaaccgtatagtacagaaacaagaaacatattgtaagtctagttatgatagttttttctaatagacaaaattggtcaacaatttattat

(The sequence listing continues in the following parts.)

What is claimed is:

1. A method of diagnosing hepatocellular carcinoma in a human patient, compnsing:
   (a) detecting the level of expression in a tissue sample of ten or more genes from Tables 3A, 3B, 5, 7A, 7B, 8A, and 8B; wherein differential expression of the genes in Tables 3A, 3B, 5, 7A, 7B, 8A, and 8B is indicative of hepatocellular carcinoma.

2. A method of detecting the progression of hepatocellular carcinoma in a human patient, comprising:
   (a) detecting the level of expression in a tissue sample of ten or more genes from Tables 3A, 3B, 5, 7A, 7B, 8A, and 8B; wherein differential expression of the genes in Tables 3A, 3B, 5, 7A, 7B, 8A, and 8B is indicative of hepatocellular carcinoma progression.

3. A method of monitoring the treatment of a human patient with hepatocellular carcinoma, comprising:
   (a) administering a pharmaceutical composition to the patient;
   (b) detecting the level of expression of ten or more genes from Tables 3A, 3B, 5, 7A, 7B 8A and 8B from a cell or tissue sample from the patient; and
   (c) comparing the patient gene expression detected in step (b) to gene expression from a cell population comprising normal liver cells or to gene expression from a cell population comprising hepatocellular carcinoma cells or both.

4. A method of diagnosing a metastatic liver cancer in a human patient, comprising:
   (a) detecting the level of expression in a tissue sample of ten or more genes from Tables 4A, 4B, 5, 6A, 6B, 9A and 9B; wherein differential expression of the genes in Tables 4A, 4B, 5, 6A, 6B, 9A, and 9B is indicative of metastatic liver cancer.

5. A method of detecting the progression of a metastatic liver cancer in a human patient, comprising:
   (a) detecting the level of expression in a tissue sample of ten or more genes from Tables 4A, 4B, 5, 6A, 6B, 9A and 9B; wherein differential expression of the genes in Tables 4A, 4B, 5, 6A, 6B, 9A, and 9B is indicative of metastatic liver cancer progression.

6. A method of monitoring the treatment of a human patient with metastatic liver cancer, comprising:
   (a) administering a pharmaceutical composition to the patient;
   (b) detecting the level of expression of ten or more genes from Tables 4A, 4B, 5, 6A, 6B, 9A and 9B from a cell or tissue sample from the patient; and
   (c) comparing the patient gene expression detected in step (b) to gene expression from a cell population comprising normal liver cells or to gene expression from a cell population comprising metastatic liver tumor cells or both.

7. A method of differentiating metastatic liver cancer from hepatocellular carcinoma in a human patient, comprising:
   (a) detecting the level of expression in a tissue sample of ten or more genes from Tables 3–9; wherein differential expression of the genes in Tables 3–9 is indicative of metastatic liver cancer rather than hepatocellular carcinoma.

8. A method of claim 1 or 4, wherein the level of expression of 100 or more genes from one or more tables selected from the group consisting of Tables 3A, 3B, 4A, 4B, 5, 6A, 6B, 7A, 7B, 8A, 8B, 9A and 9B is detected.

9. A method of claim 1 or 4, wherein the level of expression is compared to the gene information in one or more tables selected from the group consisting of Tables 3A, 3B, 4A, 4B, 5, 6A, 6B, 7A, 7B, 8A, 8B, 9A and 9B.

10. A method of diagnosing hepatocellular carcinoma or metastatic liver cancer in a human patient comprising:
    (a) detecting the level of expression of ten or more genes from Tables 3–9 from a tissue sample from the patient; and
    (b) comparing the gene expression detected in step (a) to a database comprising part of the data in Tables 3–9; wherein differential expression of the genes detected in step (a) is indicative of hepatocellular carcinoma or metastatic liver cancer.

11. A method of claim 10, wherein the cancer is hepatocellular carcinoma.

12. A method of claim 10, wherein the cancer is metastatic liver cancer.

13. A method of claim 10, wherein the database comprises all of the data from Tables 3–9.

14. A method of claim 10, wherein the database comprises gene expression information for all of the genes from Tables 3–9.

15. A method of diagnosing hepatocellular carcinoma in a human patient, comprising:
    (a) detecting the level of expression in a liver tissue sample of ten or more mRNA species from Table 3A, 3B, 5, 7A, 7B, 8A or 8B; and
    (b) comparing the detected level of expression to the level of expression of said ten or more mRNA species in a hepatocellular carcinoma liver tissue sample, thereby diagnosing hepatocellular carcinoma in the patient.

16. A method of diagnosing metastatic liver cancer in a human patient, comprising:
    (a) detecting the level of expression in a liver tissue sample of ten or more mRNA species from Table 4A, 4B, 5, 6A, 6B, 9A or 9B; and
    (b) comparing the detected level of expression to the level of expression of said ten or more mRNA species in a metastatic liver cancer tissue sample, thereby diagnosing metastatic liver cancer in the patient.

17. A method of claim 15, wherein the level of expression of said ten or more mRNA species in a hepatocellular carcinoma liver sample is in Table 3A, 3B, 5, 7A, 7B, 8A or 8B.

18. A method of claim 16, wherein the level of expression of said ten or more mRNA species in a metastatic liver cancer sample is in Table 4A, 4B, 5, 6A, 6B, 9A or 9B.

* * * * *